US011872280B2

(12) United States Patent
Roth et al.

(10) Patent No.: US 11,872,280 B2
(45) **Date of Patent: *Jan. 16, 2024**

(54) RNA VACCINE AGAINST SARS-COV-2 VARIANTS

(71) Applicants: CureVac SE, Tübingen (DE); GLAXOSMITHKLINE BIOLOGICALS SA, Rixensart (BE)

(72) Inventors: Nicole Roth, Tübingen (DE); Diego Chaves Moreno, Tübingen (DE); Hans Wolfgang Große, Tübingen (DE); Dominik Vahrenhorst, Tübingen (DE); Susanne Rauch, Tübingen (DE)

(73) Assignees: CUREVAC SE, Tübingen (DE); GLAXOSMITHKLINE BIOLOGICALS SA, Rixensart (BE)

(*) Notice: Subject to any disclaimer, the term of this patent is extended or adjusted under 35 U.S.C. 154(b) by 0 days.

This patent is subject to a terminal disclaimer.

(21) Appl. No.: 17/829,004

(22) Filed: May 31, 2022

(65) Prior Publication Data

US 2022/0331422 A1 Oct. 20, 2022

Related U.S. Application Data

(63) Continuation of application No. 17/558,257, filed on Dec. 21, 2021.

(Continued)

(30) Foreign Application Priority Data

Feb. 3, 2021 (WO) ................. PCT/EP2021/052455
Jul. 14, 2021 (WO) ................. PCT/EP2021/069626
Jul. 14, 2021 (WO) ................. PCT/EP2021/069632

(51) Int. Cl.
*A61K 39/215* (2006.01)
*A61K 9/127* (2006.01)
(Continued)

(52) U.S. Cl.
CPC .......... *A61K 39/215* (2013.01); *A61K 9/1272* (2013.01); *A61K 9/5123* (2013.01);
(Continued)

(58) Field of Classification Search
None
See application file for complete search history.

(56) References Cited

U.S. PATENT DOCUMENTS 8,058,069 B2 11/2011 Yaworski et al.
8,278,036 B2 10/2012 Kariko et al.
(Continued)

FOREIGN PATENT DOCUMENTS

CN 111228475 A 6/2020
CN 111606980 A 9/2020
(Continued)

OTHER PUBLICATIONS

Jackson et al. (The New England Journal of Medicine. Jul. 14, 2020: 383: 1920-31).*
(Continued)

*Primary Examiner* — Shanon A. Foley
(74) *Attorney, Agent, or Firm* — Birch, Stewart, Kolasch & Birch, LLP

(57) ABSTRACT

The present invention is directed to a nucleic acid suitable for use in treatment or prophylaxis of an infection with a coronavirus, preferably with a Coronavirus SARS-CoV-2, or a disorder related to such an infection, preferably COVID-19. The present invention is also directed to compositions, polypeptides, and vaccines. The compositions and vaccines preferably comprise at least one of said nucleic acid sequences, preferably nucleic acid sequences in association a lipid nanoparticle (LNP). The invention is also directed to first and second medical uses of the nucleic acid, the composition, the polypeptide, the combination, the vaccine, (Continued)

and the kit, and to methods of treating or preventing a coronavirus infection, preferably a Coronavirus infection.

24 Claims, 43 Drawing Sheets

Specification includes a Sequence Listing.

Related U.S. Application Data

(60) Provisional application No. 63/129,395, filed on Dec. 22, 2020.

(51) Int. Cl.
*A61K 31/713* (2006.01)
*C12N 15/113* (2010.01)
*A61K 9/51* (2006.01)
*A61P 31/14* (2006.01)
*A61K 47/60* (2017.01)
*A61K 47/26* (2006.01)
*C12N 7/00* (2006.01)
*A61K 47/69* (2017.01)
*A61K 39/00* (2006.01)

(52) U.S. Cl.
CPC ............ *A61K 31/713* (2013.01); *A61K 47/26* (2013.01); *A61K 47/60* (2017.08); *A61K 47/6933* (2017.08); *A61P 31/14* (2018.01); *C12N 7/00* (2013.01); *C12N 15/1131* (2013.01); *A61K 2039/53* (2013.01)

(56) References Cited

U.S. PATENT DOCUMENTS

| | | | |
|---|---|---|---|
| 8,492,359 | B2 | 7/2013 | Yaworski et al. |
| 8,691,966 | B2 | 4/2014 | Kariko et al. |
| 8,748,089 | B2 | 6/2014 | Kariko et al. |
| 8,822,668 | B2 | 9/2014 | Yaworski et al. |
| 9,006,417 | B2 | 4/2015 | Yaworski et al. |
| 9,334,328 | B2 | 5/2016 | Schrum et al. |
| 9,364,435 | B2 | 6/2016 | Yaworski et al. |
| 9,404,127 | B2 | 8/2016 | Yaworski et al. |
| 9,428,535 | B2 | 8/2016 | De Fougerolles et al. |
| 9,476,055 | B2 | 10/2016 | Sahin et al. |
| 9,504,651 | B2 | 11/2016 | MacLachlan et al. |
| 9,518,272 | B2 | 12/2016 | Yaworski et al. |
| 9,657,295 | B2 | 5/2017 | Schrum et al. |
| 9,750,824 | B2 | 9/2017 | Kariko et al. |
| 9,758,795 | B2 | 9/2017 | Cullis et al. |
| 9,850,269 | B2 | 12/2017 | DeRosa et al. |
| 9,868,692 | B2 | 1/2018 | Benenato |
| 9,943,612 | B2 | 4/2018 | Scharenberg et al. |
| 10,022,435 | B2 | 7/2018 | Ciaramella et al. |
| 10,064,934 | B2 | 9/2018 | Ciaramella et al. |
| 10,064,959 | B2 | 9/2018 | Schrum et al. |
| 10,232,055 | B2 | 3/2019 | Kariko et al. |
| 10,266,485 | B2 | 4/2019 | Benenato |
| 10,272,150 | B2 | 4/2019 | Ciaramella et al. |
| 10,442,756 | B2 | 10/2019 | Benenato et al. |
| 10,493,167 | B2 | 12/2019 | De Fougerolles et al. |
| 10,543,269 | B2 | 1/2020 | Ciaramella et al. |
| 10,577,403 | B2 | 3/2020 | De Fougerolles et al. |
| 10,583,203 | B2 | 3/2020 | De Fougerolles et al. |
| 10,702,599 | B2 | 7/2020 | Ciaramella et al. |
| 10,702,600 | B1 | 7/2020 | Ciaramella et al. |
| 10,703,789 | B2 | 7/2020 | De Fougerolles et al. |
| 10,709,779 | B2 | 7/2020 | Ciaramella et al. |
| 10,772,975 | B2 | 9/2020 | Bancel et al. |
| 10,898,574 | B2 | 1/2021 | De Fougerolles et al. |
| 10,933,127 | B2 | 3/2021 | Ciaramella et al. |
| 10,953,089 | B1 | 3/2021 | Smith et al. |
| 10,960,070 | B2 | 3/2021 | Graham et al. |
| 11,059,841 | B2 | 7/2021 | DeRosa et al. |
| 11,060,107 | B2 | 7/2021 | Weissman et al. |
| 11,078,242 | B1 | 8/2021 | Roy et al. |
| 11,141,378 | B2 | 10/2021 | Yaworski et al. |
| 11,202,793 | B2 | 12/2021 | Hoge et al. |
| 11,241,493 | B2 * | 2/2022 | Rauch ...................... C12N 7/00 |
| 2005/0032730 | A1 | 2/2005 | Von Der Mulbe et al. |
| 2005/0059624 | A1 | 3/2005 | Hoerr et al. |
| 2005/0250723 | A1 | 11/2005 | Hoerr et al. |
| 2006/0188490 | A1 | 8/2006 | Hoerr et al. |
| 2008/0025944 | A1 | 1/2008 | Hoerr et al. |
| 2008/0267873 | A1 | 10/2008 | Hoerr et al. |
| 2009/0324584 | A1 | 12/2009 | Hoerr et al. |
| 2010/0048883 | A1 | 2/2010 | Ketterer et al. |
| 2010/0189729 | A1 | 7/2010 | Hoerr et al. |
| 2010/0203076 | A1 | 8/2010 | Fotin-Mleczek et al. |
| 2010/0291156 | A1 | 11/2010 | Barner et al. |
| 2010/0305196 | A1 | 12/2010 | Probst et al. |
| 2011/0053829 | A1 | 3/2011 | Baumhof et al. |
| 2011/0250225 | A1 | 10/2011 | Fotin-Mleczek et al. |
| 2012/0021043 | A1 | 1/2012 | Kramps et al. |
| 2012/0258046 | A1 | 10/2012 | Mutzke |
| 2013/0129754 | A1 | 5/2013 | Thess et al. |
| 2013/0142818 | A1 | 6/2013 | Baumhof et al. |
| 2013/0259879 | A1 | 10/2013 | Baumhof et al. |
| 2013/0280283 | A1 | 10/2013 | Lorenz et al. |
| 2013/0295043 | A1 | 11/2013 | Kallen et al. |
| 2013/0336998 | A1 | 12/2013 | Kallen et al. |
| 2015/0037326 | A1 | 2/2015 | Butler-Ransohoff et al. |
| 2015/0050302 | A1 | 2/2015 | Thess |
| 2015/0057340 | A1 | 2/2015 | Thess et al. |
| 2015/0093413 | A1 | 4/2015 | Thess et al. |
| 2015/0118183 | A1 | 4/2015 | Baumhof |
| 2015/0118264 | A1 | 4/2015 | Baumhof et al. |
| 2015/0165006 | A1 | 6/2015 | Thess et al. |
| 2015/0184195 | A1 | 7/2015 | Thess et al. |
| 2015/0218554 | A1 | 8/2015 | Thess |
| 2015/0306249 | A1 | 10/2015 | Baumhof et al. |
| 2015/0320847 | A1 | 11/2015 | Thess et al. |
| 2016/0130345 | A1 | 5/2016 | Fotin-Mleczek et al. |
| 2016/0166668 | A1 | 6/2016 | Kallen et al. |
| 2016/0166678 | A1 | 6/2016 | Kallen et al. |
| 2016/0166710 | A1 | 6/2016 | Baumhof |
| 2016/0166711 | A1 | 6/2016 | Schnee et al. |
| 2016/0168207 | A1 | 6/2016 | Kramps et al. |
| 2016/0168227 | A1 | 6/2016 | Kallen et al. |
| 2016/0235864 | A1 | 8/2016 | Schlake et al. |
| 2016/0304883 | A1 | 10/2016 | Grund et al. |
| 2016/0304938 | A1 | 10/2016 | Wochner |
| 2016/0326575 | A1 | 11/2016 | Von Der Mulbe et al. |
| 2016/0331844 | A1 | 11/2016 | Fotin-Mleczek et al. |
| 2017/0014496 | A1 | 1/2017 | Fotin-Mleczek et al. |
| 2017/0029847 | A1 | 2/2017 | Thess |
| 2017/0114378 | A1 | 4/2017 | Wochner et al. |
| 2017/0252430 | A1 | 9/2017 | Fotin-Mleczek et al. |
| 2017/0326225 | A1 | 11/2017 | Rauch et al. |
| 2018/0044687 | A1 | 2/2018 | Thess et al. |
| 2018/0125952 | A1 | 5/2018 | Fotin-Mleczek et al. |
| 2018/0126003 | A1 | 5/2018 | Hoerr |
| 2018/0142275 | A1 | 5/2018 | Roos et al. |
| 2018/0147146 | A1 | 5/2018 | Eber et al. |
| 2018/0148727 | A1 | 5/2018 | Grund et al. |
| 2018/0201967 | A1 | 7/2018 | Eber et al. |
| 2018/0208957 | A1 | 7/2018 | Roos et al. |
| 2018/0214537 | A1 | 8/2018 | Mutzke et al. |
| 2018/0237786 | A1 | 8/2018 | Schlake et al. |
| 2018/0237817 | A1 | 8/2018 | Roos et al. |
| 2018/0243219 | A1 | 8/2018 | Ketterer et al. |
| 2018/0296663 | A1 | 10/2018 | Hipp et al. |
| 2018/0298372 | A1 | 10/2018 | Funkner et al. |
| 2018/0303925 | A1 | 10/2018 | Weissman et al. |
| 2018/0312545 | A1 | 11/2018 | Baumhof et al. |
| 2018/0371392 | A1 | 12/2018 | Mayer et al. |
| 2019/0010485 | A1 | 1/2019 | Yazdan Panah et al. |
| 2019/0017100 | A1 | 1/2019 | Wochner et al. |
| 2019/0024096 | A1 | 1/2019 | Schmid et al. |
| 2019/0040378 | A1 | 2/2019 | Fotin-Mleczek et al. |
| 2019/0049414 | A1 | 2/2019 | Wochner et al. |
| 2019/0083602 | A1 | 3/2019 | Roos et al. |
| 2019/0100784 | A1 | 4/2019 | Eber et al. |

(56) References Cited

U.S. PATENT DOCUMENTS

| | | | |
|---|---|---|---|
| 2019/0125857 | A1 | 5/2019 | Rauch et al. |
| 2019/0133950 | A1 | 5/2019 | Eber et al. |
| 2019/0160164 | A1 | 5/2019 | Rauch et al. |
| 2019/0177714 | A1 | 6/2019 | Kunze et al. |
| 2019/0185859 | A1 | 6/2019 | Fotin-Mleczek et al. |
| 2019/0194760 | A1 | 6/2019 | Koch et al. |
| 2019/0225971 | A1 | 7/2019 | Williams |
| 2019/0240317 | A1 | 8/2019 | Ciaramella et al. |
| 2019/0241633 | A1 | 8/2019 | Fotin-Mleczek et al. |
| 2019/0249219 | A1 | 8/2019 | Reichert et al. |
| 2019/0336608 | A1 | 11/2019 | Baumhof et al. |
| 2019/0336611 | A1 | 11/2019 | Baumhof et al. |
| 2019/0343933 | A1 | 11/2019 | Horscroft et al. |
| 2019/0343942 | A1 | 11/2019 | Fotin-Mleczek et al. |
| 2019/0351044 | A1 | 11/2019 | Jasny et al. |
| 2019/0351047 | A1 | 11/2019 | Jasny et al. |
| 2019/0351048 | A1 | 11/2019 | Rauch |
| 2019/0381180 | A1 | 12/2019 | Baumhof et al. |
| 2020/0023076 | A1 | 1/2020 | Fotin-Mleczek et al. |
| 2020/0061185 | A1 | 2/2020 | Graham et al. |
| 2020/0085852 | A1 | 3/2020 | Fotin-Mleczek |
| 2020/0085944 | A1 | 3/2020 | Heidenreich et al. |
| 2020/0149026 | A1 | 5/2020 | Horscroft et al. |
| 2020/0163878 | A1 | 5/2020 | Baumhof et al. |
| 2020/0179526 | A1 | 6/2020 | Baumhof et al. |
| 2020/0197510 | A1 | 6/2020 | Ciaramella et al. |
| 2020/0282046 | A1 | 9/2020 | Ciaramella et al. |
| 2020/0318097 | A1 | 10/2020 | Funkner et al. |
| 2020/0392572 | A1 | 12/2020 | Yazdan Panah et al. |
| 2021/0023199 | A1 | 1/2021 | Kallen et al. |
| 2021/0030864 | A1 | 2/2021 | Petsch et al. |
| 2021/0030866 | A1 | 2/2021 | Kallen et al. |
| 2021/0060175 | A1 | 3/2021 | Fotin-Mleczek et al. |
| 2021/0162037 | A1 | 6/2021 | Jasny et al. |
| 2021/0170017 | A1 | 6/2021 | Lutz et al. |
| 2021/0222178 | A1 | 7/2021 | Linke et al. |
| 2021/0228707 | A1 | 7/2021 | Metkar et al. |
| 2021/0228708 | A1 | 7/2021 | Smith et al. |
| 2021/0228709 | A1 | 7/2021 | Smith et al. |
| 2021/0246170 | A1 | 8/2021 | Langedijk et al. |
| 2021/0253645 | A1 | 8/2021 | Gershoni et al. |
| 2022/0347289 | A1 | 11/2022 | Chen et al. |

FOREIGN PATENT DOCUMENTS

| | | | |
|---|---|---|---|
| CN | 111606981 | A | 9/2020 |
| CN | 111647053 | A | 9/2020 |
| CN | 111732638 | A | 10/2020 |
| CN | 111778264 | A | 10/2020 |
| CN | 111821433 | A | 10/2020 |
| CN | 111333704 | B | 1/2021 |
| CN | 112226445 | A | 1/2021 |
| CN | 112266411 | A | 1/2021 |
| CN | 112300251 | A | 2/2021 |
| CN | 112390863 | A | 2/2021 |
| EP | 2 357 230 | A1 | 8/2011 |
| EP | 2791160 | B1 | 3/2014 |
| EP | 3 318 248 | A1 | 5/2018 |
| EP | 3 336 082 | A1 | 6/2018 |
| EP | 3 431 485 | A1 | 1/2019 |
| EP | 3 492 109 | A1 | 6/2019 |
| GN | 111518175 | B | 2/2021 |
| WO | WO 02/098443 | A2 | 12/2002 |
| WO | WO 2006/068663 | A2 | 6/2006 |
| WO | WO 2006/078294 | A2 | 7/2006 |
| WO | WO 2007/024708 | A2 | 3/2007 |
| WO | WO 2008/016473 | A2 | 2/2008 |
| WO | WO 2008/077592 | A1 | 7/2008 |
| WO | WO 2008/157688 | A2 | 12/2008 |
| WO | WO 2009/030481 | A1 | 3/2009 |
| WO | WO 2009/127060 | A1 | 10/2009 |
| WO | WO 2009/149253 | A2 | 12/2009 |
| WO | WO 2011/005799 | A2 | 1/2011 |
| WO | WO 2011/015347 | A1 | 2/2011 |
| WO | WO 2011/068810 | A1 | 6/2011 |
| WO | WO 2011/069586 | A1 | 6/2011 |
| WO | WO 2011/071931 | A2 | 6/2011 |
| WO | WO 2011/076807 | A2 | 6/2011 |
| WO | WO 2012/006369 | A2 | 1/2012 |
| WO | WO 2012/006372 | A1 | 1/2012 |
| WO | WO 2012/006377 | A2 | 1/2012 |
| WO | WO 2012/006378 | A1 | 1/2012 |
| WO | WO 2012/019780 | A1 | 2/2012 |
| WO | WO 2012/030901 | A1 | 3/2012 |
| WO | WO 2012/031043 | A1 | 3/2012 |
| WO | WO 2012/031046 | A2 | 3/2012 |
| WO | WO 2012/116810 | A1 | 9/2012 |
| WO | WO 2012/116811 | A1 | 9/2012 |
| WO | WO 2013/006825 | A1 | 1/2013 |
| WO | WO 2013/035563 | A1 | 3/2013 |
| WO | WO 2013/059475 | A1 | 4/2013 |
| WO | WO 2013/143700 | A2 | 10/2013 |
| WO | WO 2015/062738 | A1 | 5/2015 |
| WO | WO 2015/101416 | A1 | 7/2015 |
| WO | WO 2015/164674 | A1 | 10/2015 |
| WO | WO 2015/188933 | A1 | 12/2015 |
| WO | WO 2015/199952 | A1 | 12/2015 |
| WO | WO 2016/022914 | A1 | 2/2016 |
| WO | WO 2016/091391 | A1 | 6/2016 |
| WO | WO 2016/107877 | A1 | 7/2016 |
| WO | WO 2016/165831 | A1 | 10/2016 |
| WO | WO 2016/174271 | A1 | 11/2016 |
| WO | WO 2016/176330 | A1 | 11/2016 |
| WO | WO 2016/180430 | A1 | 11/2016 |
| WO | WO 2016/184575 | A1 | 11/2016 |
| WO | WO 2016/184576 | A2 | 11/2016 |
| WO | WO 2016/193206 | A1 | 12/2016 |
| WO | WO 2016/193226 | A2 | 12/2016 |
| WO | WO 2017/001058 | A1 | 1/2017 |
| WO | WO 2017/004143 | A1 | 1/2017 |
| WO | WO 2017/025447 | A1 | 2/2017 |
| WO | WO 2017/036580 | A1 | 3/2017 |
| WO | WO 2017/053297 | A1 | 3/2017 |
| WO | WO 2017/066781 | A1 | 4/2017 |
| WO | WO 2017/066782 | A1 | 4/2017 |
| WO | WO 2017/066789 | A1 | 4/2017 |
| WO | WO 2017/066791 | A1 | 4/2017 |
| WO | WO 2017/066793 | A1 | 4/2017 |
| WO | WO 2017/066797 | A1 | 4/2017 |
| WO | WO 2017/070626 | A2 | 4/2017 |
| WO | WO 2017/075531 | A1 | 5/2017 |
| WO | WO 2017/081082 | A2 | 5/2017 |
| WO | WO 2017/109161 | A1 | 6/2017 |
| WO | WO 2017/137095 | A1 | 8/2017 |
| WO | WO 2017/140905 | A1 | 8/2017 |
| WO | WO 2018/075827 | A1 | 4/2018 |
| WO | WO 2018/078053 | A1 | 5/2018 |
| WO | WO 2018/081318 | A1 | 5/2018 |
| WO | WO 2018/081480 | A1 | 5/2018 |
| WO | WO 2018/170347 | A1 | 9/2018 |
| WO | WO 2018/172556 | A1 | 9/2018 |
| WO | WO 2018/211038 | A1 | 11/2018 |
| WO | WO 2019/077001 | A1 | 4/2019 |
| WO | WO 2019/092153 | A1 | 5/2019 |
| WO | WO 2019/193183 | A2 | 10/2019 |
| WO | WO 2019/222424 | A1 | 11/2019 |
| WO | WO 2019/226925 | A1 | 11/2019 |
| WO | WO 2019/232095 | A1 | 12/2019 |
| WO | WO 2019/232097 | A1 | 12/2019 |
| WO | WO 2019/232208 | A1 | 12/2019 |
| WO | WO 2020/002525 | A1 | 1/2020 |
| WO | WO 2020/002598 | A1 | 1/2020 |
| WO | WO 2020/127959 | A1 | 6/2020 |
| WO | WO 2020/128031 | A2 | 6/2020 |
| WO | WO 2021/030701 | A1 | 2/2021 |
| WO | WO 2021/123332 | A1 | 6/2021 |
| WO | WO 2021/147025 | A1 | 7/2021 |
| WO | WO 2021/151099 | A1 | 7/2021 |
| WO | WO 2021/154763 | A1 | 8/2021 |
| WO | WO 2021/154828 | A1 | 8/2021 |
| WO | WO 2021/155323 | A1 | 8/2021 |
| WO | WO 2021/155760 | A1 | 8/2021 |
| WO | WO 2021/156267 | A1 | 8/2021 |
| WO | WO 2021/159040 | A2 | 8/2021 |

(56) References Cited

FOREIGN PATENT DOCUMENTS

| | | |
|---|---|---|
| WO | WO 2021/159985 A1 | 8/2021 |
| WO | WO 2021/160036 A1 | 8/2021 |
| WO | WO 2021/160346 A1 | 8/2021 |
| WO | WO 2021/160850 A1 | 8/2021 |
| WO | WO 2021/160881 A1 | 8/2021 |
| WO | WO 2021/161043 A1 | 8/2021 |
| WO | WO 2021/163222 A1 | 8/2021 |
| WO | WO 2021/163365 A1 | 8/2021 |
| WO | WO 2021/163371 A1 | 8/2021 |
| WO | WO 2021/163398 A1 | 8/2021 |
| WO | WO 2021/163427 A1 | 8/2021 |
| WO | WO 2021/163438 A1 | 8/2021 |
| WO | WO 2021/163456 A1 | 8/2021 |
| WO | WO 2021/163536 A2 | 8/2021 |
| WO | WO 2021/163584 A1 | 8/2021 |
| WO | WO 2021/163622 A1 | 8/2021 |
| WO | WO 2021/202734 A2 | 10/2021 |
| WO | WO 2021/209970 A1 | 10/2021 |
| WO | WO 2021/213924 A1 | 10/2021 |
| WO | WO 2021/213945 A1 | 10/2021 |
| WO | WO 2021/214204 A1 | 10/2021 |
| WO | WO 2021/222304 A1 | 11/2021 |
| WO | WO 2021/228842 A1 | 11/2021 |
| WO | WO 2021/236854 A1 | 11/2021 |
| WO | WO 2021/243122 A2 | 12/2021 |
| WO | WO 2021/245611 A1 | 12/2021 |
| WO | WO 2022/067010 A1 | 3/2022 |
| WO | WO 2022/110099 A1 | 6/2022 |
| WO | WO 2022/155524 A1 | 7/2022 |
| WO | WO 2022/155530 A1 | 7/2022 |
| WO | WO 2022/180219 A1 | 9/2022 |
| WO | WO 2023/051701 A1 | 4/2023 |
| WO | WO 2023/064907 A1 | 4/2023 |
| WO | WO 2023/086961 A1 | 5/2023 |

OTHER PUBLICATIONS

Dao et al., "SARS-CoV-2 Infectivity and Severity of COVID-19 According to SARS-CoV-2 Variants: Current Evidence," Journal of Clinical Medicine, vol. 10, 2021, pp. 1-35.
International Search Report and Written Opinion of the International Searching Authority for International Application No. PCT/IB2021/062127, dated Jun. 13, 2022.
(CHMP), "COVID-19 vaccine moderna, Common name: COVID-19 mRNA Vaccine (nucleoside-modified)", Assessment Report, European Medicines Agency, Jan. 6, 2021, pp. 1-169.
"CureVac: Final Analysis of Pivotal Phase 2b/3 HERALD Study", presentation, Jul. 1, 2021.
"Final Analysis of Phase 2b/3 Clinical Trial of First Generation COVID-19 Vaccine Candidate, CVnCoV", transcript of conference call, Jul. 1, 2021.
Anderson et al., "Safety and Immunoaenicity of SARS-CoV-2 mRNA-1273 Vaccine in Older Adults", The New England Journal of Medicine, vol. 383, 2020 (Published Sep. 29, 2020), pp. 1-12.
Baden et al., "Efficacy and Safety of the mRNA-1273 SARS-CoV-2 Vaccine", The New England Journal of Medicine, vol. 384, 2021 (Published Dec. 30, 2020), pp. 1-14.
Comimaty, "Common name: COVID-19 mRNA vaccine (nucleoside-modified)", Assessment Report, European Medicines Agency, Dec. 21, 2020, pp. 1-140.
Corbett et al., "Evaluation of the mRNA-1273 Vaccine against SARS-CoV-2 in Nonhuman Primates", The New England Journal of Medicine, vol. 383, 2020 (Published Jul. 28, 2020 and updated Aug. 7, 2020), pp. 1-12.
Corbett et al., "SARS-CoV-2 mRNA vaccine development enabled by prototype pathogen preparedness", bioRxiv preprint, Jun. 11, 2020, 39 pages.
CureVac, "CureVac Final Data from Phase 2b/3 Trial of First-Generation COVID-19 Vaccine Candidate, CVnCoV, Demonstrates Protection in Age Group of 18 to 60", press release, Jun. 30, 2021, 4 pages.
CureVac, "CureVac Provides Update on Phase 2b/3 Trial of First-Generation COVID-19 Vaccine Candidate, CVnCoV", press release, Jun. 16, 2021, 4 pages.
CureVac, "CureVac: Second Interim Analysis of Pivotal Phase 2b/3 HERALD Study", presentation, Jun. 17, 2021, pp. 1-14 (15 pages total).
CureVac, "Result of Second Interim Analysis of CureVac's Pivotal Phase 2b/3 HERALD Study", presentation, CureVac Conference Call transcript, Jun. 17, 2021, pp. 1-14.
Database EMBL Accession No. MN908947, "Severe acute respiratory syndrome coronavirus 2 isolate Wuhan-Hu-1, complete genome" 2020, pp. 1-11.
Gebre et al., "Optimization of non-coding regions for a non-modified mRNA COVID-19 vaccine", Nature, vol. 601, Jan. 20, 2022 (Published online Nov. 18, 2021), pp. 410-414 (18 pages total).
Gebre et al., "Optimization of Non-Coding Regions Improves Protective Efficacy of an mRNA SARS-CoV-2 Vaccine in Nonhuman Primates", bioRxiv Preprint, Aug. 16, 2021, pp. 1-26 (36 pages total).
GenBank Accession No. MN908947.1, "Wuhan seafood market pneumonia virus isolate Wuhan-Hu-1, complete genome", Jan. 12, 2020, pp. 1-16.
Gerhardt et al., "A Thermostable, Flexible RNA Vaccine Delivery Platform for Pandemic Response", bioRxiv preprint, Feb. 2, 2021, pp. 1-16 and pp. 1-10 (26 pages total).
Gorbalenya et al., "The species Severe acute respiratory syndrome-related coronavirus: classifying 2019-nCoV and naming it SARS-CoV-2," Nat. Microbiology, vol. 5, Mar. 2020, pp. 536-544.
Hoffmann et al., "CVnCoV protects human ACE2 transgenic mice from ancestral B BavPat1 and emerging B.1.351 SARS-CoV-2", bioRxiv preprint, Mar. 22, 2021, 16 pages.
Huang et al., "Clinical features of patients infected with 2019 novel coronavirus in Wuhan, China," Lancet, vol. 395, Feb. 15, 2020 (Published Online Jan. 24, 2020), pp. 497-506.
International Search Report dated Jun. 25, 2021 for Application No. PCT/EP2021/052455.
Jackson et al., "An mRNA Vaccine against SARS-CoV-2—Preliminary Report", The New England Journal of Medicine, vol. 383, 2028 (Published Jul. 14, 2020, pp. 1-12).
Jiang et al., "SARS Vaccine Development," Emerging Infectious Diseases, vol. 11, No. 7, Jul. 2005, pp. 1016-1020.
Kakodkar et al., "A Comprehensive Literature Review on the Clinical Presentation, and Management of the Pandemic Coronavirus Disease 2019 (COVID-19)", Cureus, vol. 12, No. 4, 2020 (Published Apr. 6, 2020) e7560 pp. 1-18.
Kirchdoerfer et al. "Stabilized coronavirus spikes are resistant to conformational changes induced by receptor recognition or proteolysis", Scientific Rep., vol. 8, No. 1, 2018 (Published online Oct. 24, 2018), pp. 1-11.
Kusters et al., "Manufacturing Vaccines for an Emerging Viral Infection—Specific Issues Associated with the Development of a Prototype SARS Vaccine", Vaccine for Biodefense and Emerging and Neglected Diseases, 2009 (Published online Jan. 30, 2009), pp. 1-13.
Maruggi et al. "mRNA as a Transformative Technology for Vaccine Development to Control Infectious Diseases", Mol Ther., vol. 27, No. 4, Apr. 2019, pp. 757-772.
Muik et al., "Neutralization of SARS-CoV-2 lineage B.1.1.7 pseudovirus by BNT162b2 vaccine-elicited human sera," bioRxiv preprint, Jan. 18, 2021, pp. 1-6.
NCBI Accession No. NC_045512.1, "Wuhan seafood market pneumonia virus isolate Wuhan-Hu-1, complete genome", Jan. 13, 2020, pp. 1-12.
Ou et al. "Characterization of spike glycoprotein of SARS-CoV-2 on virus entry and its immune cross-reactivity with SARS-CoV", Nature Com., vol. 1, No. 1, 2020, pp. 1-12.
Pallesen et al. "Immunogenicity and structures of a rationally designed profusion MERS-CoV spike antigen", PNAS, vol. 14, No. 35, 2017 (Published online Aug. 14, 2017), pp. E7348-E7357.
Perlman et al., "Immunopathogenesis of Coronavirus Infectious: Implications for SARS," Nature Reviews Immunology, vol. 5, Dec. 2005, pp. 917-927.

(56) References Cited

OTHER PUBLICATIONS

Polack et al., "Safety and Efficacy of the BNT162b2 mRNA Covid-19 Vaccine", The New England Journal of Medicine, vol. 383, 2020 (Published Dec. 10, 2020 and updated Dec. 16, 2020) pp. 1-13.
Rauch et al., "mRNA based SARS-CoV-2 vaccine candidate CVnCoV induces high levels of virus neutralizing antibodies and mediates protection in rodents", bioRxiv preprint, Feb. 9, 2021, pp. 1-25.
Rauch et al., "mRNA vaccine CVnCoV protects non-human primates from SARS-CoV-2 challenge infection", bioRxiv preprint, Dec. 23, 2020, pp. 1-28.
Rauch et al., "New Vaccine Technologies to Combat Outbreak Situations", Frontiers in Immunology, vol. 9, Article 1963, Sep. 2018, pp. 1-24.
Registry Nos. 2749948-25-0, Dec. 19, 2021, 2692611-88-2, Sep. 10, 2021, 2758016-89-4, Feb. 3, 2022, 2755828-88-5, Jan. 7, 2022, 2741858-84-2, Dec. 6, 2021, 2730004-45-0, Nov. 11, 2021, 2696398-77-1, Sep. 16, 2021, and 2695574-78-6, Sep. 15, 2021, STN Database, Accessed Feb. 9, 2022.
Sahin et al., "Concurrent human antibody and TH1 type T-cell responses elicited by a COVID-19 RNA vaccine," medRxiv preprint, Jul. 20, 2020, pp. 1-18 (27 pages total).
Schrörs et al., "Large-soale analysis of SARS-CoV-2 spike-glycoprotein mutants demonstrates the need for continuous screening of virus isolates," bioRxiv preprint, Mar. 15, 2021, pp. 1-20.
U.S. Appl. No. 62/967,006, entitled "Coronavirus RNA vaccines," filed Jan. 28, 2020.
Vogel et al., "A prefusion SARS-CoV-2 spike RNA vaccine is highly immunogenic and prevents lung infection in non-human primates", bioRxiv preprint, Sep. 8, 2020, pp. 1-38.
Vogel et al., "BNT162b vaccines are immunogenic and protect non-human primates against SARS-CoV-2", bioRxiv preprint, Dec. 11, 2020, pp. 1-71.
Wang et al., "An Evidence Based Perspective on mRNA-SARS-CoV-2 Vaccine Development", Medical Science Monitor, vol. 26, 2020 (Published May 5, 2020), pp. e924700-1-e924700-8.
Widge et al., "Durability of Responses after SARS-CoV-2 mRNA-1273 Vaccination", The New England Journal of Medicine, vol. 384, 2021, pp. 1-4.
Ball et al., "Lipid Nanoparticie Formulations for Enhanced Co-delivery of siRNA and mRNA," Nano Letters, vol. 18, 2018, pp. 3814-3822.
BioNTech 2021 Annual Report, "Combined Management Report 2021," BioNTech, 2021, 27 pages.
BioNTech Press Release, "Pfizer and BioNTech Achieve First Authorization in the World for a Vaccine to Combat COVID-19," BioNTech, Dec. 2, 2020, 3 pages.
Burger et al., "Stabilizing Formulations for Inhalable Powders of Live-Attenuated Measles Virus Vaccine," Journal of Aerosol Medicine and Pulmonary Drug Delivery, vol. 21, No. 1, Mar. 8, 2008, 3 pages.
Chan et al., "A familial cluster of pneumonia associated with the 2013 novel coronavirus indicating person-to-person transmission: a study of a family cluster," Lancet, vol. 395, Feb. 15, 2020, pp. 514-523.
GenBank Accession No. MN908947.2, "Wuhan seafood market pneumonia virus isolate Wuhan-Hu-1, complete genome", Jan. 14, 2020, pp. 1-11.
Hassett et al., "Optimization of Lipid Nanoparticles for intramuscular Administration of mRNA Vaccines," Molecular Therapy Nucleic Acids, vol. 15, Apr. 2019, pp. 1-11.
Invitation to Pay Additional Fees with Communication Relating to the Results of the Partial International Search (PCT/ISA/206) for PCT/EP2021/052455, dated Apr. 29, 2021.
Li et al., "Preparation and Optimization of Lipid-Like Nanoparticles for mRNA Delivery," Methods in Molecular Biology, vol. 1632, pp. 207-217.
Lu et al., "Genomic characterisation and epidemiology of 2019 novel coronavirus: implications for virus origins and receptor binding," Lancet, vol. 395, Feb. 22, 2020, pp. 565-574.
Mani et al., "Codon Optimization of the Major Antigen Encoding Genes of Diverse Strains of Influenza A Virus," Interdiscip Sci Comput Life Sci, vol. 3 2011, pp. 36-42.
Pardi et al., "Nucleoside-modified mRNA vaccines induce potent T follicular helper and germinal center B cell responses," Journal of Experimental Medicine, 2018, vol. 215, No. 6, pp. 1571-1588.
Programme for 1st International mRNA Health Conference, organized by University of Tübingen, the University Hospital of Tübingen, and CureVac, Tübingen, Germany, Oct. 23-24, 2013, 15 pages.
Wu et al., "A new coronavirus associated with human respiratory disease in China," Nature, vol. 579, Mar. 12, 2020, 20 pages.
Zhang et al., "The D614G mutation in the SARS-CoV-2 spike protein reduces S1 shedding and increases infectivity," The Scripps Research Institute, 2020, 25 pages.
Zhou et al., "A pneumonia outbreak associated with a new coronavirus of probable bat origin," Nature, vol. 579, Mar. 12, 2020, 20 pages.
Anderson et al. "Incorporation of pseudouridine into mRNA enhances translation by diminishing PKR activation," Nucleic Acids Research, vol. 38, No. 17, 2010, pp. 5884-5892.
Andries et al., "N(1)-Methylpseudouridine-Incorporated mRNA Outperforms Pseudouridine-Incorporated mRNA by Providing Enhanced Protein Expression and Reduced Immunogenicity in Mammalian Cell Lines and Mice," Journal of Controlled Release, vol. 217, 2015, pp. 337-344.
Benton et al., "The effect of the D614G substitution on the structure ofthe spike glycoprotein of SARS-CoV-2," Proc. Natl. Acad. Sci. USA, vol. 118, No. 35, 2021, e2022586118.
Cai et al., "Distinct conformational states of SARS-CoV-2 spike protein," Science, vol. 369, No. 6511, 2020, pp. 1586-1592, 12 pages total.
Daniloski et al., "The Spike D614G mutation increases SARS-CoV-2 infection of multiple human cell types," Elife, 10: e65365, 2021.
Deering, et al., "Nucleic acid vaccines: prospects for non-viral delivery of mRNA vaccines." Expert Opinion Drug Delivery, vol. 11, No. 6, 2014, pp. 885-899.
Gobeil et al., "D614G Mutation Alters SARS-CoV-2 Spike Conformation and Enhances Protease Cleavage at the S1/S2 Junction," Cell Reports, vol. 34, 2021, p. 108630.
Grifoni et al., "Targets of T Cell Responses to SARS-CoV-2 Coronavirus in Humans with COVID-19 Disease and Unexposed Individuals," Cell, vol. 181, 2020, pp. 1489-1501.
Hsieh et al., "Structure-based design of prefusion-stabilized SARS-CoV-2 spikes," Science, vol. 369, 2020, pp. 1501-1505.
Kariko et al. "Incorporation of Pseudouridine into mRNA yields Superior Nonimmunogenic Vector with Increased Translational Capacity and Biological Stability," Mol. Ther., vol. 16, No. 11, 2008, pp. 1833-1840, 18 pages total.
Kariko et al., "Generating the optimal mRNA for therapy: HPLC purification eliminates immune activation and improves translation of nucleoside-modified, protein-encoding mRNA," Nucleic Acids Research , vol. 39, No. 21, Sep. 2, 2011, e142, published online (10 pages).
Ke et al., "Structures and distributions of SARS-CoV-2 spike proteins on intact virions" Nature, vol. 588, 2020, p. 498, 21 pages total.
Korber et al., "Tracking Changes in SARS-CoV-2 Spike: Evidence that D614G Increases Infectivity of the COVID-19 Virus," Cell, vol. 182, No. 4, 2020, pp. 812-827.
Koyama et al., "Emergence of Drift Variants That May Affect COVID-19 Vaccine Development and Antibody Treatment," Pathogens, vol. 9, No. 342, 2020, 7 pages).
Le et al., "The COVID-19 vaccine development landscape," Nat Rev Drug Disc, vol. 19, 2020, pp. 305-306.
Letko et al., "Functional assessment of cell entry and receptor usage for SARS-CoV-2 and other lineage B betacoronaviruses," Nature Microbiology, vol. 5, 2020, pp. 562-569.
Li and Dong, In: RNA Nano-structures: Methods and Protocols, Methods in Molecular Biology, 1632, 2017, eds. Eckart Bindewald and Bruce A. Shapiro.
MacLachlan, I., "Liposomal formulations for nucleic acid delivery", Antisense Drug Technologies, 2nd Edition, Chapter 9, 2007, p. 237, 34 pages total.

(56) References Cited

OTHER PUBLICATIONS

Pascolo, Steve, "Vaccination with Messenger RNA (mRNA)," Handboook of Experimental Pharmacology, vol. 183, 2008, pp. 221-235.
Pinto et al., "Cross-neutralization of SARS-CoV-2 by a human monoclonal SARS-CoV antibody," Nature, vol. 583, 2020, p. 290, 22 pages total.
Plante et al., "Spike mutation D614G alters SARS-CoV-2 fitness," Nature, vol. 592, No. 7852, 2021, pp. 116-121.
Riley et al., "Enhancing the Prefusion Conformational Stability of SARS-CoV-2 Spike Protein Through Structure-Guided Design," Front Immunol., 12:660198, 2021 (13 pages).
Sahin et al., "mRNA-based therapeutics—developing a new class of drugs," Nature Reviews Drug Discovery, vol. 13, 2014, pp. 759-780.
Tian et al., "Potent binding of 2019 novel coronavirus spike protein by a SARS coronavirus-specific human monoclonal antibody," Emerg. Microbes Infect., vol. 9, 2020, pp. 382-385.
Toyoshima et al., "SARS-CoV-2 genomic variations associated with mortality rate of COVID-19," J. of Hum. Gen. (2020) 65:1075-1082.
Wan et al., "Receptor Recognition by the Novel Coronavirus from Wuhan: an Analysis Based on Decade-Long Structural Studies of SARS Coronavirus," J. of Virol, vol. 94, No. 7, 2020, pp. e00127-20.
Wang et al., "Structural and Functional Basis of SARS-CoV-2 Entry by Using Human ACE2," Cell, vol. 181, 2020, pp. 894, 21 pages total.
Wrapp et al., "Cryo-EM structure of the 2019-nCoV spike in the prefusion conformation," Science, vol. 367, 2020, pp. 1260-1263.
Xiong et al., "A thermostable, closed SARS-CoV-2 spike protein trimer," Nature Structural & Molecular Biology, vol. 27, 2020, p. 934, 19 pages total.
Xue et al., "Lipid-Based Nanocarriers for RNA Delivery," Curr Pharm Des., vol. 21, No. 22, 2015, pp. 3140-3147 (doi: 10.2174/1381612821666150531164540).
Yang et al., "D614G mutation in the SARS-CoV-2 spike protein enhances viral fitness by desensitizing it to temperature-dependent denaturation," J. Biol. Chem., 297(4):101238, 2021.
Zhang et al., "SARS-CoV-2 spike-protein D614G mutation increases virion spike density and infectivity," Nature Commun., 11(1):6013, 2020.
Zhang et al., "Structural impact on SARS-CoV-2 spike protein by D614G substitution," Science, 372:525-530, 2021.
Zhang et al., "Structure of SARS-CoV-2 spike protein," Curr. Opin. in Virol., 50:173-182, 2021.
Armbruster et al., "Advances in RNA Vaccines for Preventive Indications: A Case Study of a Vaccine against Rabies," Vaccines, vol. 7, No. 132, 2019, pp. 1-12.
Battles et al., "Structure and immunogenicity of pre-fusion-stabilized human metapneumovirus F glycoprotein," Nature Communications, vol. 8, No. 1528, 2017, pp. 1-11.
Becerra-Flores et al., "SARS-CoV-2 viral spike G614 mutation exhibits higher case fatality rate," International Journal of Clinical Practice, vol. 74, 2020, e13525, pp. 1-4.
Bhattacharya et al., "D614G mutation and SARS-CoV-2: impact on S-protein structure, function, infectivity, and immunity," Applied Microbiology and Biotechnology, vol. 105, 2021, pp. 9035-9045.
Bhattacharyya et al., "Global Spread of SARS-CoV-2 Subtype with Spike Protein Mutation D614G is Shaped by Human Genomic Variations that Regulate Expression of TMPRSS2 and MX1 Genes," bioRxiv, 2020, pp. 1-25, 30 pages total.
Carnell et al., "SARS-CoV-2 spike protein arrested in the closed state induces potent neutralizing responses," Journal of Virology, vol. 95, No. 15, 2021, pp. 1-27.
Chan et al., "Genomic characterization of the 2019 novel human-pathogenic coronavirus isolated from a patient with atypical pneumonia after visiting Wuhan," Emerging Microbes & Infections, vol. 9, 2020, pp. 221-236.
Chang et al., "Synthesis and solution conformation studies of 3-substituted uridine and pseudouridine derivatives," Bioorganic & Medicinal Chemistry, vol. 16, 2008, pp. 2676-2686.
Crooke, "Antisense Drug Technology: Principles, Strategies, and Applications, Liposomal Formulations for Nucleic Acid Delivery," CRC Press, Second Edition, 2009, pp. 237-270.
Du et al., "The spike protein of SARS-CoV—a target for vaccine and therapeutic development," Nature Reviews Microbiology, vol. 7, 2009, pp. 226-236.
Fechter et al., "Recognition of mRNA cap structures by viral and cellular proteins," Journal of General Virology, vol. 86, 2005, pp. 1239-1249.
Follis et al., "Furin cleavage of the SARS coronavirus spike glycoprotein enhances cell-cell fusion but does not affect virion entry," Virology, vol. 350, 2006, pp. 358-369.
Furuichi et al., "Viral and Cellular mRNA Capping: Past and Prospects," Advances in Virus Research, vol. 55, 2000, pp. 135-184.
Goel et al., "Distinct antibody and memory B cell responses in SARS-CoV-2 naïve and recovered individuals following mRNA vaccination," Science Immunology, 2021, pp. 1-19.
Gorbalenya et al., "The species Severe acute respiratory syndrome-related coronavirus: classifying 2019-nCoV and naming it SARS-CoV-2," Nature Microbiology, vol. 5, 2020, pp. 536-544.
GT Rijkers, Expert Opinion on CureVac's Vaccine Utility Model DE 20 2021 003 575 U1, Hoyng Rokh Monegier, Jul. 19, 2023, 20 pages total.
Gui et al., "Cryo-electron microscopy structures of the SARS-CoV spike glycoprotein reveal a prerequisite conformational state for receptor binding," Cell Research, vol. 27, 2017, pp. 119-129.
Hastie et al., "Structural basis for antibody-mediated neutralization of Lassa virus," Science, vol. 356, No. 6341, 2017, pp. 923-928.
Holtkamp et al., "Modification of antigen-encoding RNA increases stability, translational efficacy, and T-cell stimulatory capacity of dendritic cells," Blood, vol. 108, No. 13, 2006, pp. 4009-4017.
International Preliminary Report and English translation of the Written Opinion of the International Searching Authority dated Jul. 6, 2023 for Application No. PCT/IB2021/062127.
Karikó et al., "Suppression of RNA Recognition by Toll-like Receptors: The Impact of Nucleoside Modification and the Evolutionary Origin of RNA," Immunity, vol. 23, 2005, pp. 165-175.
Krarup et al., "A highly stable prefusion RSV F vaccine derived from structural analysis of the fusion mechanism," Nature Communications, vol. 6, No. 8143, 2015, pp. 1-12.
Li et al., "Structure of SARS Coronavirus Spike Receptor-Binding Domain Complexed with Receptor," Science, vol. 309, No. 5742, 2005, pp. 1864-1868.
Madhi et al., "Efficacy of the ChAdOx1 nCoV-19 Covid-19 Vaccine against the B.1.351 Variant," The New England Journal of Medicine, 2021, pp. 1-14.
Morais et al., "The Critical Contribution of Pseudouridine to mRNA Covid-19 Vaccines," Frontiers in Cell and Developmental Biology, vol. 9, Article 789427, 2021, pp. 1-9.
Motorin et al., "RNA nucleotide methylation," WIREs RNA, vol. 2, 2011, pp. 611-631.
Motorin et al., "RNA nucleotide methylation: 2021 update," WIREs RNA, vol. 13, 2022, pp. 1-37.
Orlandini Von Niessen et al., "Improving mRNA-Based Therapeutic Gene Delivery by Expression-Augmenting 3' UTRs Identified by Cellular Library Screening," Molecular Therapy, vol. 27, No. 4, 2019, pp. 824-836.
Pardi et al., "Zika virus protection by a single low dose nucleoside modified mRNA vaccination," Nature, vol. 5, No. 7644, 2017, pp. 248-251.
Pascolo, "Messenger RNA-based vaccines," Expert Opinion on Biological Therapy, vol. 4, No. 8, 2004, pp. 1285-1294.
Roychoudhury et al., "Severe acute respiratory syndrome coronavirus 2 surface glycoprotein," Database, EMBL:QIQ68534, submitted on Mar. 26, 2020, 2 pages total.
Sanders et al., "A Next-Generation Cleaved, Soluble HIV-1 Env Trimer, BG505 SOSIP.664 gp140, Expresses Multiple Epitopes for Broadly Neutralizing but Not Non-Neutralizing Antibodies," PLOS Pathogens, vol. 9, No. 9, e1003618, 2013, pp. 1-20.

(56) References Cited

OTHER PUBLICATIONS

Sanders et al., "Virus vaccines: proteins prefer prolines," Cell Host & Microbe, vol. 29, 2021, pp. 327-333.
Schlake et al., "Developing mRNA-vaccine technologies," RNA Biology, vol. 9, No. 11, 2012, pp. 1319-1330.
Schoenmaker et al., "miRNA-lipid nanoparticle Covid-19 vaccines: Structure and stability," International Journal of Pharmaceutics, vol. 601, 2021, pp. 1-13.
Song et al., "Cryo-EM structure of the SARS coronavirus spike glycoprotein in complex with its host cell receptor ACE2," PLOS Pathogens, vol. 14, No. 8, 2018, pp. 1-19.
Van Nuffel et al., "Dendritic Cells Loaded With mRNA Encoding Full-length Tumor Antigens Prime CD4+ and CD8+ T Cells in Melanoma Patients," Molecular Therapy, vol. 20, No. 5, 2012, pp. 1063-1074.
Yamamoto et al., "Current prospects for mRNA gene delivery," European Journal of Pharmaceutics and Biopharmaceutics, 2008, pp. 1-6.
Zaki et al., "Isolation of a Novel Coronavirus from a Man with Pneumonia in Saudi Arabia," The New England Journal of Medicine, vol. 367, No. 19, 2012, pp. 1814-1820.
Zhu et al., "A Novel Coronavirus from Patients with Pneumonia in China, 2019" The New England Journal of Medicine, vol. 382, No. 8, 2020, pp. 727-733.
U.S. Appl. No. 18/327,882, filed Jun. 1, 2023.
U.S. Appl. No. 18/268,736, filed Jun. 21, 2023.

* cited by examiner

C

D

E

F

G

H

A

B

C

A

B

C

A

B

C

D

E

F

G

H

A

B

C

D

E

F

G

H

RNA VACCINE AGAINST SARS-COV-2 VARIANTS

This application is a Continuation of copending application Ser. No. 17/558,257, filed on Dec. 21, 2021, which claims priority under 35 U.S.C. § 119(e) to U.S. Provisional Application No. 63/129,395, filed on Dec. 22, 2020, and under 35 U.S.C. § 119(a) to Application No. PCT/EP2021/052455, filed in Europe on Feb. 3, 2021; Application No. PCT/EP2021/069626, filed in Europe on Jul. 14, 2021; and Application No. PCT/EP2021/069632, filed in Europe on Jul. 14, 2021, all of which are hereby expressly incorporated by reference into the present application.

BACKGROUND OF THE INVENTION

The present invention is inter alia directed to an RNA suitable for use in treatment or prophylaxis of an infection with SARS-CoV-2 variants, including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia), or a disorder related to such infections. The present invention also concerns compositions, polypeptides, and vaccines. The compositions and vaccines preferably comprise at least one of said RNA sequences, preferably RNA in association with lipid nanoparticles (LNPs).

List

The invention is also directed to first and second medical uses of the RNA, the composition, the vaccine, and the kit, and to methods of treating or preventing a SARS-CoV-2 infection caused by SARS-Cov-2 variants, including, but not limited to: C.1.2 (South Africa), B.1.1.529 (Omicron, South Africa) (including BA.1 v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brae). B.1.427/8.1.429 (Epsilon, Calif., US), B.1.525 (Eta, Nigeria), B.1258 (Czech republic), B.1.526 (Jots, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

Coronaviruses are highly contagious, enveloped, positive single stranded zoonotic RNA viruses of the Coronaviridae family.

Coronaviruses are genetically highly variable, and individual virus species have the potential to infect several host species by overcoming the species barrier. In late 2019, an outbreak of respiratory disease caused by a novel Coronavirus strain was reported in Wuhan City, Hubei Province, China. The novel Coronavirus was named "severe acute respiratory syndrome coronavirus 2" (SARS-CoV-2). Typical symptoms of a SARS-CoV-2 caused virus infection, also referred to as COVID-19 disease, include fever, cough, shortness of breath, and pneumonia, with high mortality rates in the elderly population. In March 2020, the WHO declared the SARS-CoV-2 outbreak a pandemic. In addition, some individuals suffer the effects of COVID-19 infection for weeks to months after infection. This population is referred to "long Covid". Common signs and symptoms that linger over time include: fatigue, shortness of breath or difficulty breathing, cough, joint pain, chest pain, memory, concentration or sleep problems, muscle pain or headache, fast or pounding heartbeat, loss of smell or taste, depression or anxiety, fever, dizziness on standing, worsened symptoms after physical or mental activities.

During the pandemic, new SARS-CoV-2 variant strains were emerging that are often more contagious or more pathogenic than the original SARS-CoV-2 strain. Such new emerging SARS-CoV-2 strains may potentially lead to a reduced efficiency of first-generation vaccines that were developed against the original SARS CoV-2 strain. Further, k is unclear whether a boost vaccination with a vaccine specifically designed against new emerging SARS-CoV-2 strains in subjects which have been vaccinated against the original SARS CoV-2 strain will lead to protective immune responses against the new emerging SARS-CoV-2 strains.

SUMMARY OF THE INVENTION

Therefore, it is one object of the underlying invention to provide an RNA-based vaccine for SARS-CoV-2 infections, in particular SARS-CoV-2 infections caused by novel emerging SARS-CoV-2 variant strains. Such novel emerging strains include but not limited to: C.1.2 (South Africa), B.1.1.529 (Omicron, South Africa) (including BA.1_v1, BA.1 v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/8.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia). RNA based vaccination represents one of the most promising techniques for new vaccines against new emerging SARS-CoV-2 viruses. RNA can be genetically engineered and adapted to new emerging SARS-CoV-2 strains and administered to a human subject, where transfected cells directly produce the encoded antigen provided by the RNA which results in immunological responses.

As further defined in the claims and the underlying description, these objects are inter alia solved by providing an RNA comprising at least one coding sequence encoding at least one antigenic peptide or protein derived from SARS-CoV-2, e.g. comprising at least one mutation derived from a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1 v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/8.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

In a preferable embodiment of the invention the RNA and RNA-based vaccine comprises an RNA encoding at least one antigenic peptide derived from a SARS-CoV-2 spike protein, e.g. comprising a spike protein from derived from a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1 v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia)

BRIEF DESCRIPTION OF THE DRAWINGS

FIG. 1A shows comparable IgG1 response for all groups (ancestral SARS-CoV-2 receptor binding domain (RBD) protein coating) and FIG. 1 B shows comparable IgG2a titers for all vaccination designs (ancestral RBD protein coating). On day 14, FIG. 1 C shows comparable IgG1 response for all vaccination designs (RBD B.1.351 variant K417N, E484K, N501Y protein coating) and FIG. 1 D shows comparable IgG2a titers for all vaccination designs (RBD B.1.351 variant K417N, E484K, N501Y protein coating). On day 21, FIG. 1 E shows comparable IgG1 response for all vaccination designs (ancestral SARS-CoV-2 receptor binding domain (RBD) protein coating) and FIG. 1 F shows comparable IgG2a titers for all vaccination designs (ancestral SARS-CoV-2 receptor binding domain (RBD) protein coating). On day 21, FIG. 1 G shows comparable IgG1 response for all vaccination designs (RBD B.1.351 variant K417N, E484K, N501Y protein coating) and FIG. 1 H shows comparable IgG2a titers for all vaccination designs (RBD B.1.351 variant K417N, E484K, N501Y protein coating).

FIG. 2A on day 14 and FIG. 2 B on day 21 show an increase of the VNT for all groups B—H. Co-delivery of the mRNA vaccine CV2CoV and the CV2CoV.351 into the same leg (group F and G) or different legs (group H) can generate responses against both vaccine variants on day 14 and day 21. FIG. 2 C on day 42 shows an increased level of VNT for all groups (group B—H). Co-delivery of both vaccine variants into the same leg (group F and G) or into different legs (group H) can generate responses against both variants on day 42.

FIG. 3A on day 14 and FIG. 3 B on day 21 show an increase of the VNT for all groups B—H. Co-delivery of the mRNA vaccine CV2CoV and the CV2CoV.351 into the same leg (group F and G) or different legs (group H) can generate responses against both vaccine variants on day 14 and day 21. FIG. 3 C on day 42 shows an increased level of VNT for all groups (group B—H). Co-delivery of both vaccine variants into the same leg (group F and G) or into different legs (group H) can generate responses against both variants on day 42.

FIG. 4A on day 42 shows an increased level of VNT using B.1.1.7 variant for all groups (group B—H). Co-delivery of both vaccine variants into the same leg (group F and G) or into different legs (group H) can generate responses against both variants on day 42. FIG. 4 B on day 42 shows an increased level of VNT using B.1.1.28 P.1 variant for all groups (group B—H). Co-delivery of both vaccine variants into the same leg (group F and G) or into different legs (group H) can generate responses against both variants on day 42.

FIG. 6 also shows significant induction of VNTs assessed in a CPE-based using B.1.1.7 variant SARS-CoV-2 (FIG. 6 G) or B.1.1.28 P.1 variant (FIG. 6 H) on day 42. FIG. 6A shows that the B.1.351 variant vaccine CV2CoV.351 induces dose-dependent VNTs against ancestral SARS-CoV-2 (heterologous response) on day 14 in all dose groups. Compared to responses upon vaccination with CV2CoV (homologous response), VNTs in CV2CoV.351 vaccinated groups are decreased by a factor of approx. 2 on day 14. FIG. 6 B shows that CV2CoV.351 induces dose-dependent VNTs against B.1.351 SARS-CoV-2 (homologous response) on day 14 in all dose groups. CV2CoV.351 vaccination elicited high levels of VNTs against homologous virus that were 45× increased on day 14, compared to heterologous VNTs against ancestral virus (average difference of all dose groups). In comparison to vaccination with CV2CoV, VNTs induced by CV2CoV.351 were increased by a factor of 41 on day 14 (average difference of all dose groups). FIG. 6 C shows that the B.1.351 variant vaccine CV2CoV.351 induces dose-dependent VNTs against ancestral SARS-CoV-2 (heterologous response) on day 21 in all dose groups. Compared to responses upon vaccination with CV2CoV (homologous response), VNTs in CV2CoV.351 vaccinated groups are decreased by a factor of approx. 2 on day 21. FIG. 6 D shows that CV2CoV.351 induces slightly dose-dependent VNTs against B.1.351 SARS-CoV-2 (homologous response) on day 21 in all dose groups. CV2CoV.351 vaccination elicited high levels of VNTs against homologous virus that were 35× increased on day 21, compared to heterologous VNTs against ancestral virus (average difference of all dose groups). In comparison to vaccination with CV2CoV, VNTs induced by CV2CoV.351 were increased by a factor of 42 on day 21 (average difference of all dose groups). FIG. 6 E shows that the B.1.351 variant vaccine CV2CoV.351 induced dose-dependent VNTs against ancestral SARS-CoV-2 (heterologous response) on day 42 in all dose groups. Slightly higher responses except for all vaccinations with 0.5 μg (group F) were shown upon vaccination with CV2CoV (homologous response). FIG. 6 F shows that CV2CoV.351 induces dose-dependent VNTs against B.1.351 SARS-CoV-2 (homologous response) on day 42 in all dose groups. In comparison to vaccination with CV2CoV, VNTs induced by CV2CoV.351 were increased on day 42. FIG. 6 G shows that the B.1.351 variant vaccine CV2CoV.351 induces dose-dependent VNTs against B.1.1.7 variant SARS-CoV-2 (heterologous response) on day 42 in all dose groups. Similar responses for group H except for vaccination with 0.5 μg (group F) were shown upon vaccination with CV2CoV (homologous response). FIG. 6 H shows that CV2CoV.351 induces dose-dependent VNTs against B.1.1.28 P.1 variant SARS-CoV-2 (homologous response) on day 42 in all dose groups. Lower responses were seen upon vaccination with CV2CoV (homologous response).

FIGS. 7 K and 7 L also show significant induction of VNTs assessed in a CPE-based assay using.1.1.7 variant SARS-CoV-2 (FIG. 7 K) or B.1.1.28 P.1 variant (FIG. 7 L) on day 42.

FIG. 9 D: B.1.1.7; FIG. 9 E: B.1.351; FIG. F: P1). FIGS. 9 G-J show cellular immune responses of CD8 (FIGS. 9 G and 9 I) and CD4 (FIGS. 9H and 9J) positive T-cells in mice stimulated with a mixture of ancestral SARS-CoV-2 peptide library (FIGS. 9 G and H) or stimulated with a mixture of B.1.351 SARS-CoV-2 peptide library (FIGS. 9 I and J), using an intracellular cytokine staining assay.

FIG. 12 C, 12 D, 12 E: VNTs against SARS-CoV-2 B.1.617.2 on day 14, day 21, and day 42, respectively). Robust VNTs were induced not only against homologous SARS-CoV-2 variant (B.1.617.2) but also against heterologous SARS-CoV-2 ancestral and SARS-CoV-2 variants B.1.351 and P.1 (FIG. 12 F: ancestral, FIG. G: B.1.351, FIG. 12 H: P.1).

FIG. 13 B: delta RBD (L452R, T478K); FIG. 13 C: beta RBD (K417N, E484K, N501Y).

FIGS. 14 K and M, for B.1.617.2: FIGS. 14 L and N). Induction of anti-RBD total immunoglobulins is shown in FIG. 14 O: challenge group B.1.351 and FIG. 14 P: challenge group B.1.617.2.

Figure 14:
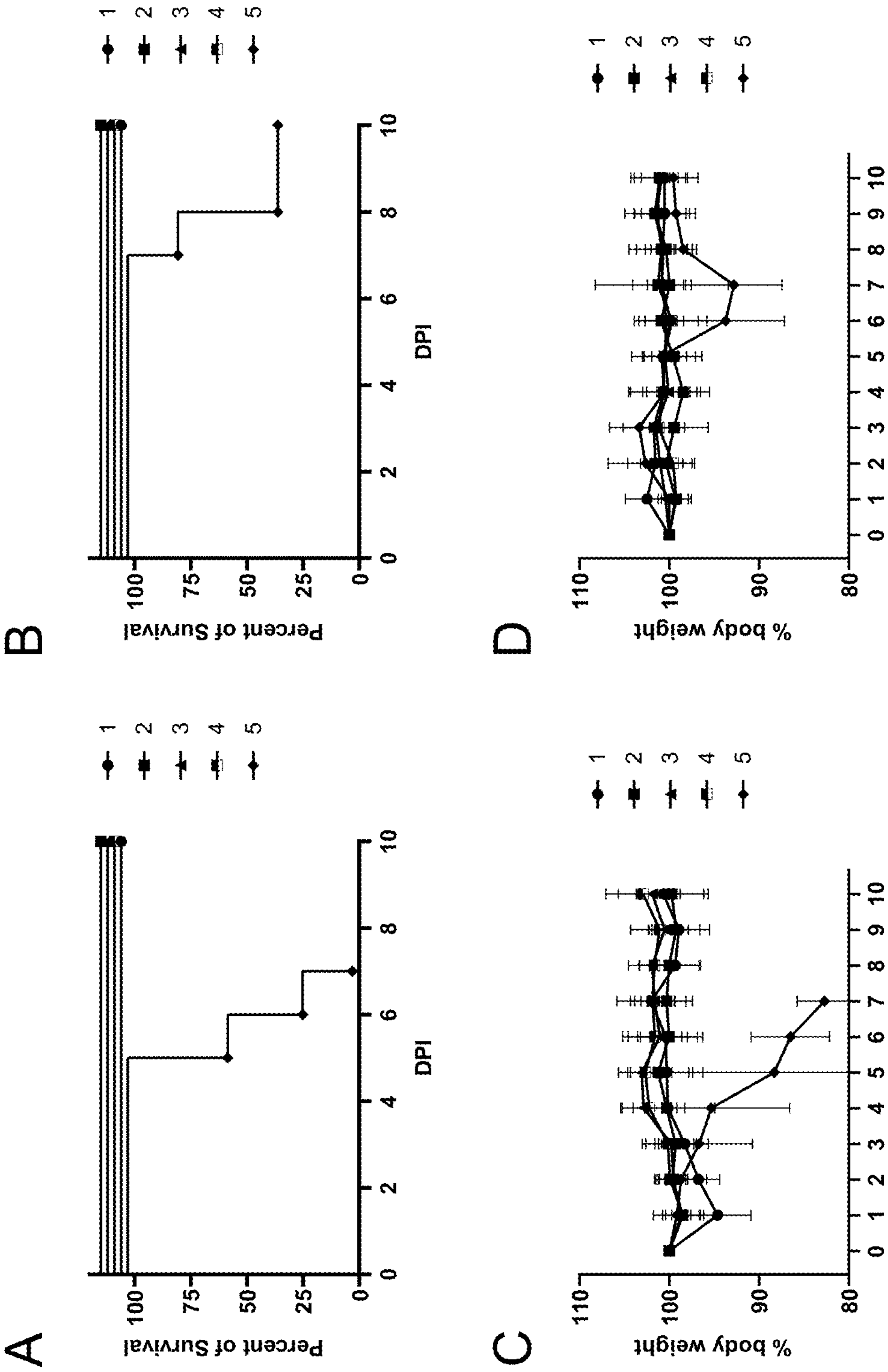
FIG. 14 shows vaccine efficacy by challenging mice with either SARS-CoV-2 variant B.1.351 or SARS CoV-2 variant B.1.627.2. Survival of challenged mice is shown in FIG. 14A: challenge with B.1.351 and FIG. 14 B: challenge with B.1.617.2. Mean percentage body weight changes are shown in FIG. 14 C: challenge with B.1.351 and FIG. 14 D: challenge with B.1.617.2. Viral RNA load in saliva is shown in FIG. 14 E: B.1.351 challenge group, and FIG. 14 F: B.1.617.2 challenge group. Viral load in the upper respiratory tract (URT) (conchae) demonstrates FIG. 14 G for B.1.351 challenge group and FIG. 14 H for B.617.2 challenge group) and in the lower respiratory tract (LRT) (lung) in FIG. 14 I (challenge with B.1.351) and J (challenge with B.1.617.2). Viral load in brain is shown in FIG. 14 K to FIG. N (FIGS. 14 K and L for cerebellum, FIGS. 14 M and N for Cerebrum (for challenge group B.1.351.
Figure 14:
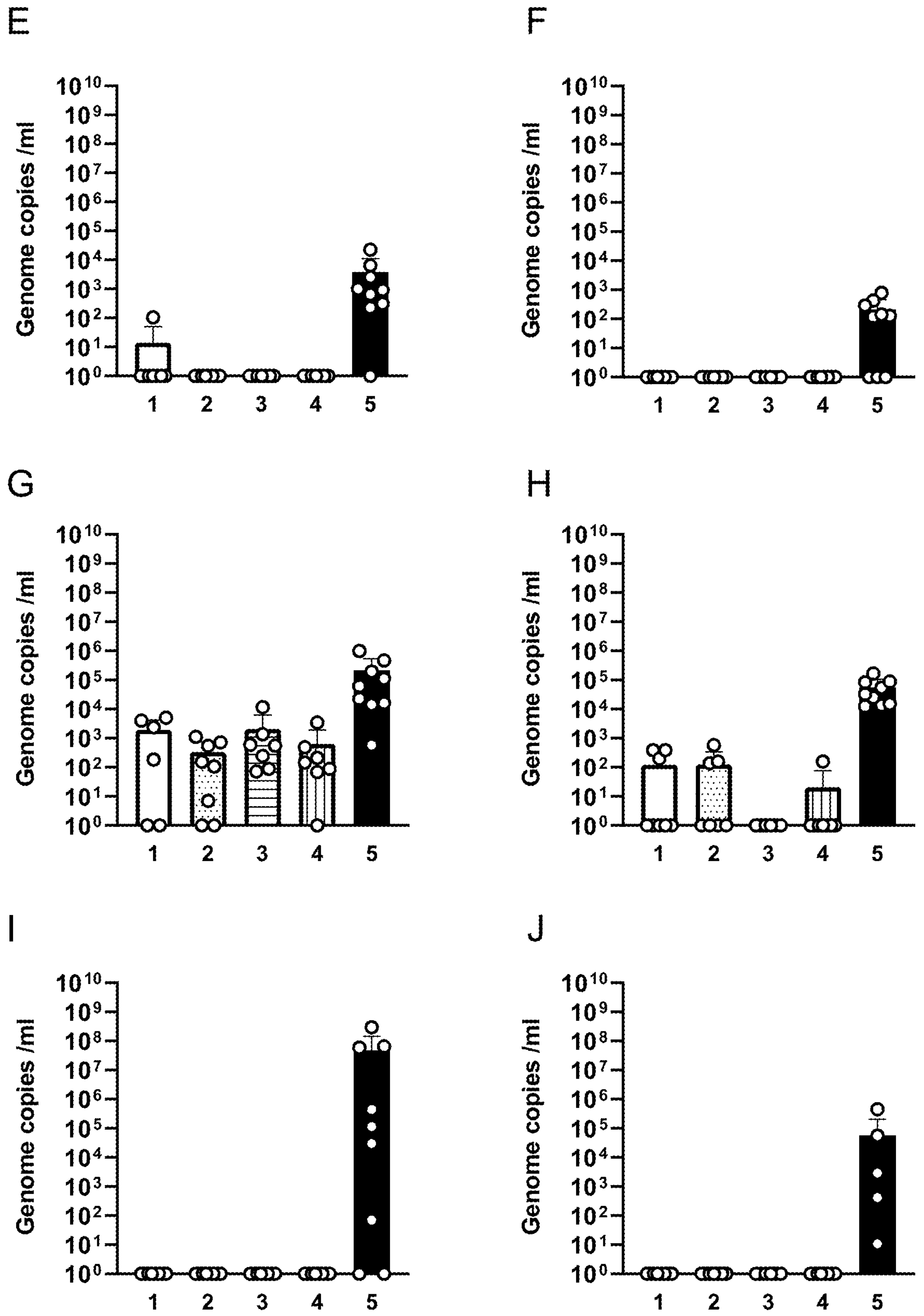
Figure 14:
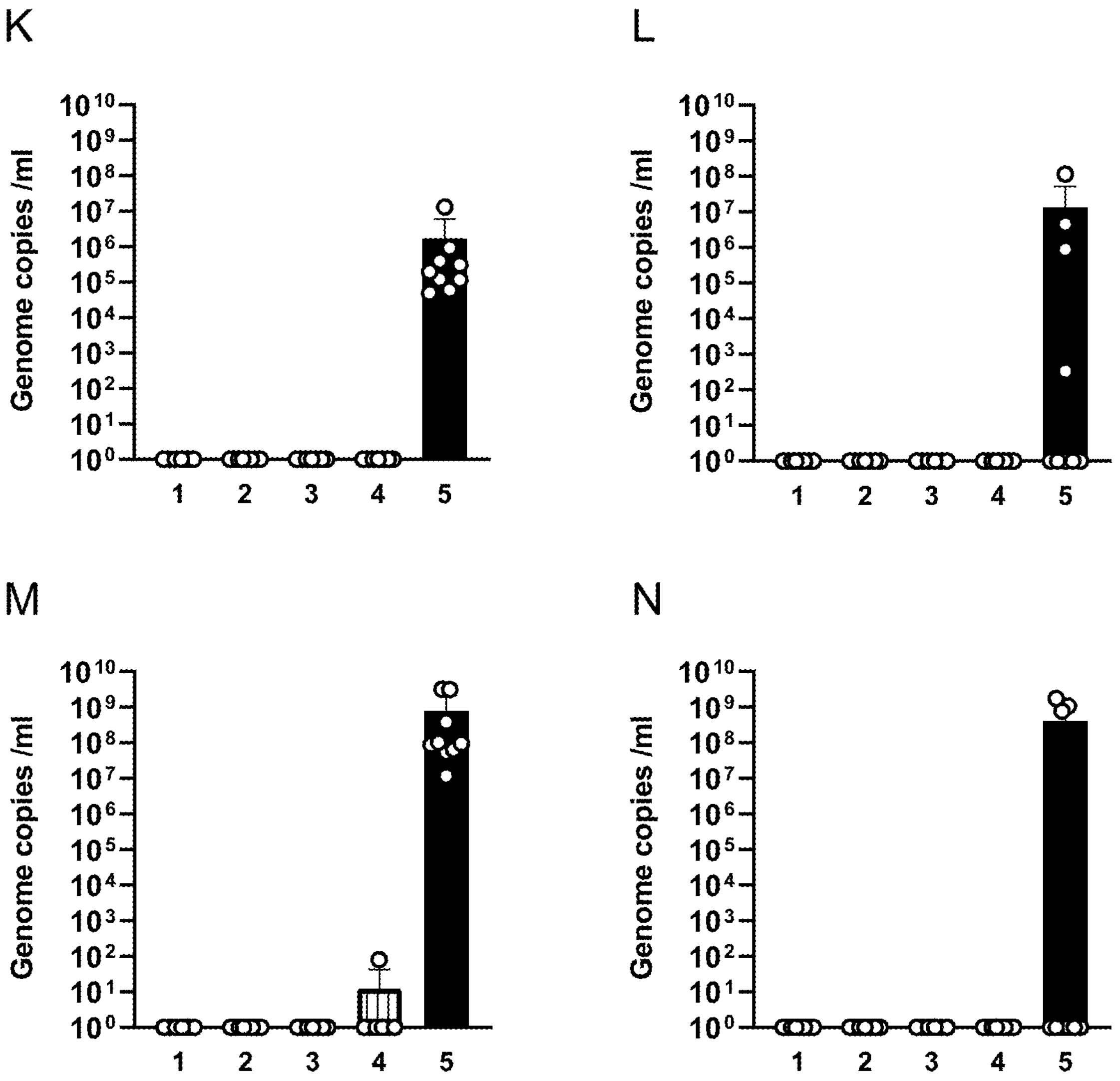
Figure 14:
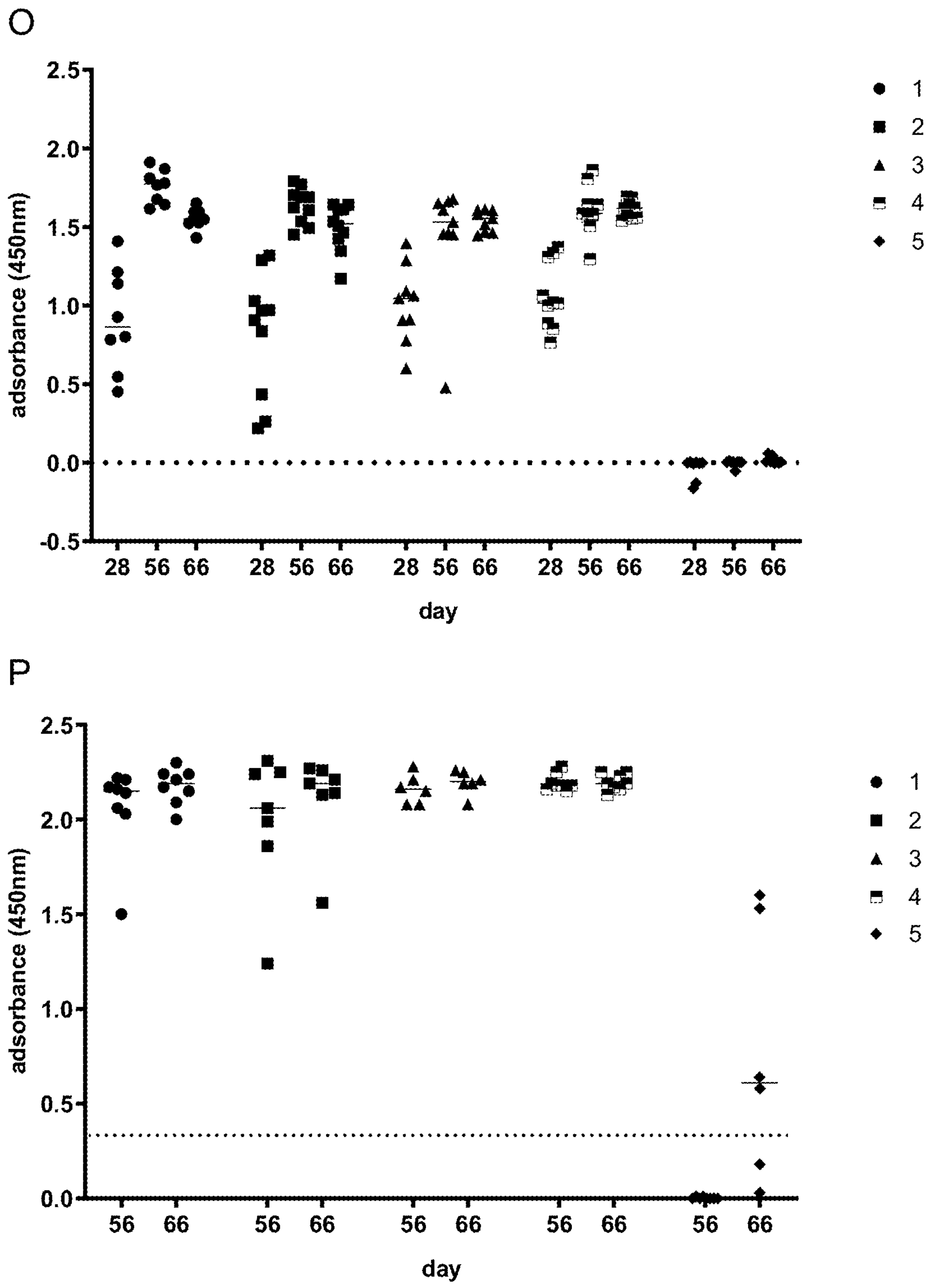
Figure 14:
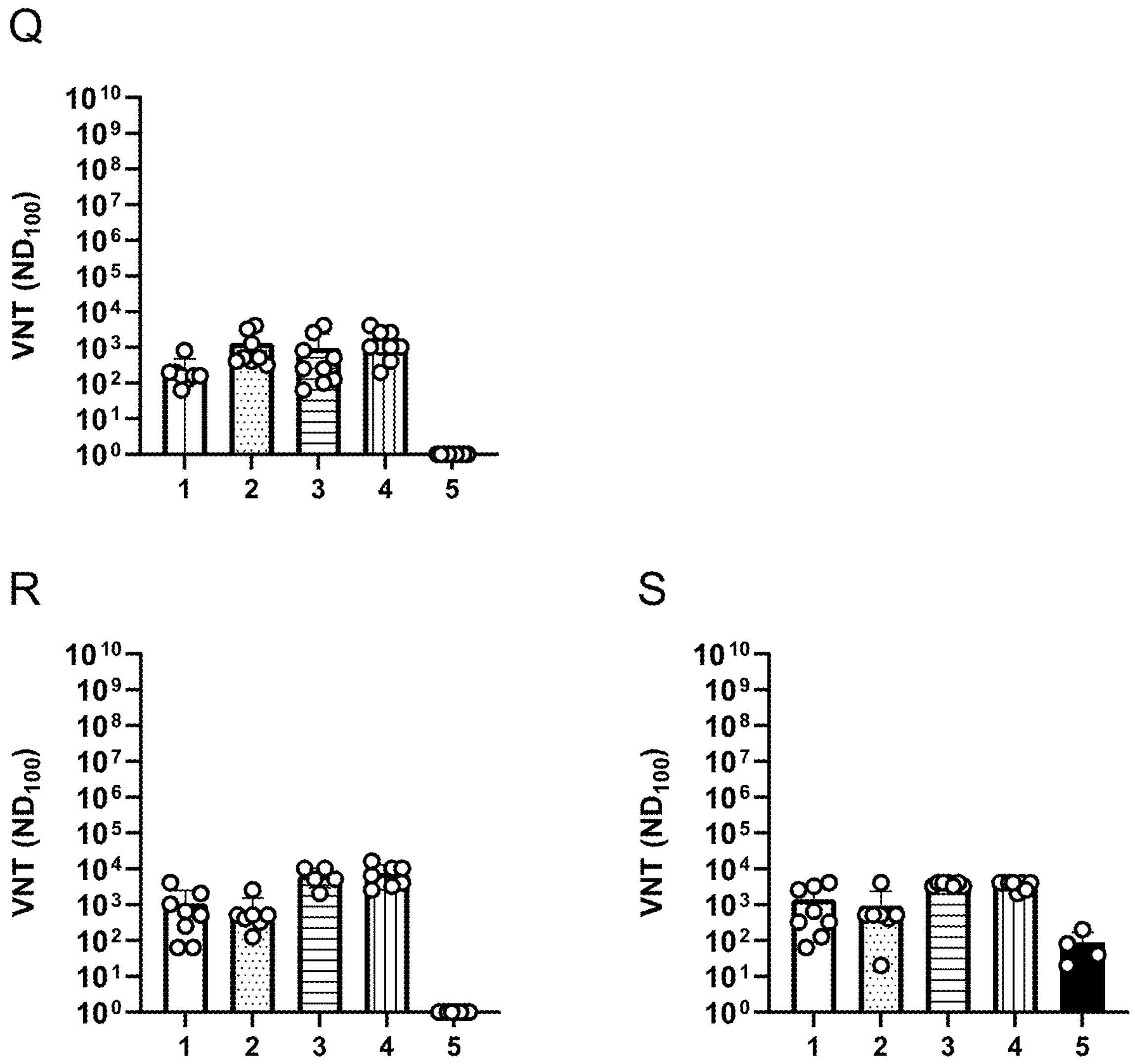

and VNTs in FIG. 14 Q: post-challenge group B.1.351, FIG. 14 R: pre-challenge group B.1.617.2, and FIG. 14 S: post-challenge group B.1.617.2.

Figure 15:
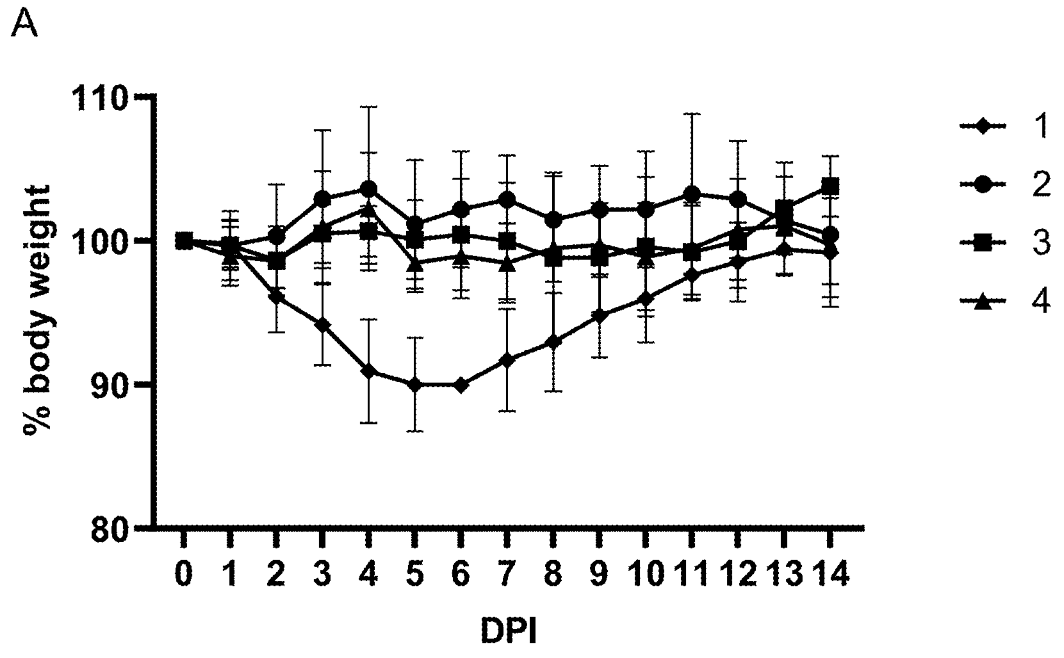
Figure 15:
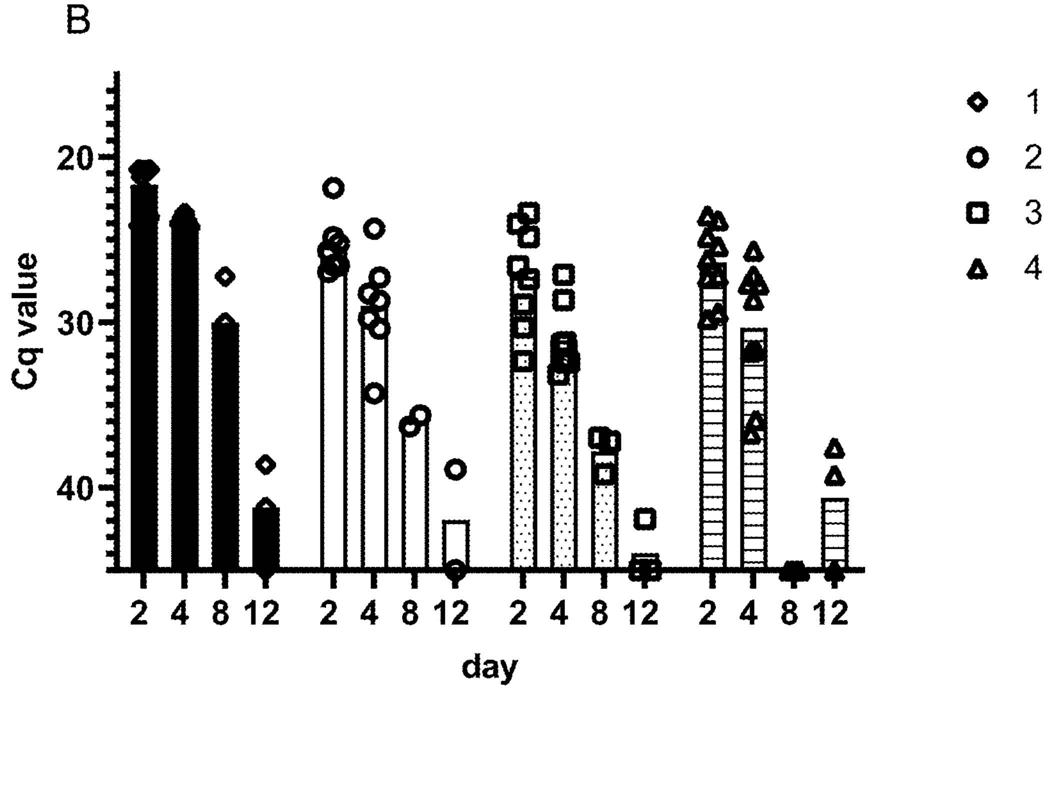
Figure 15:
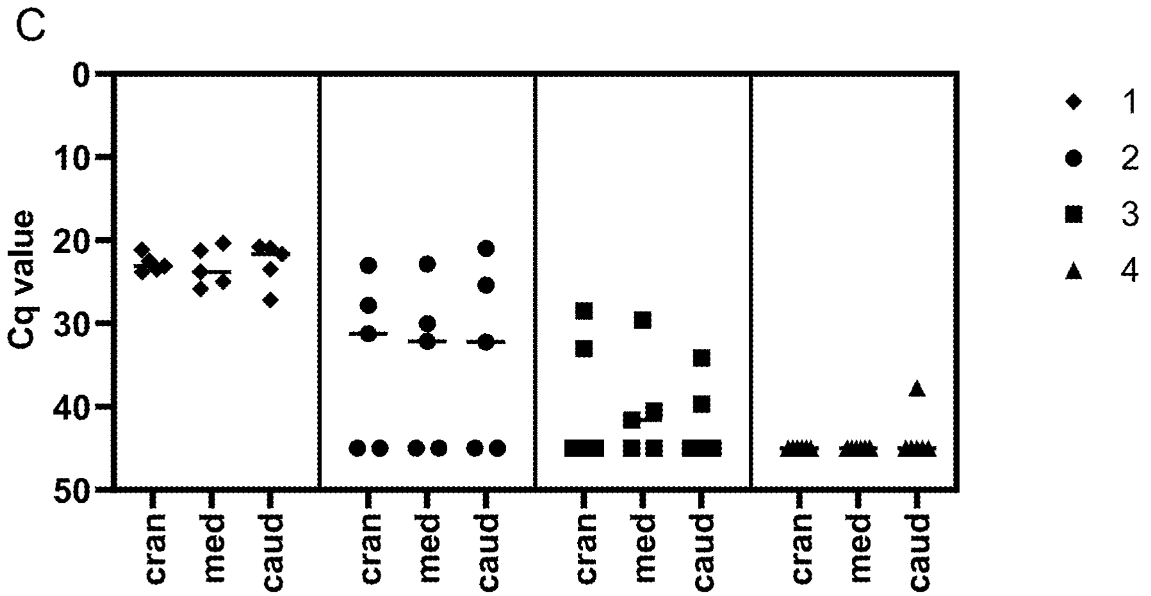
Figure 15:
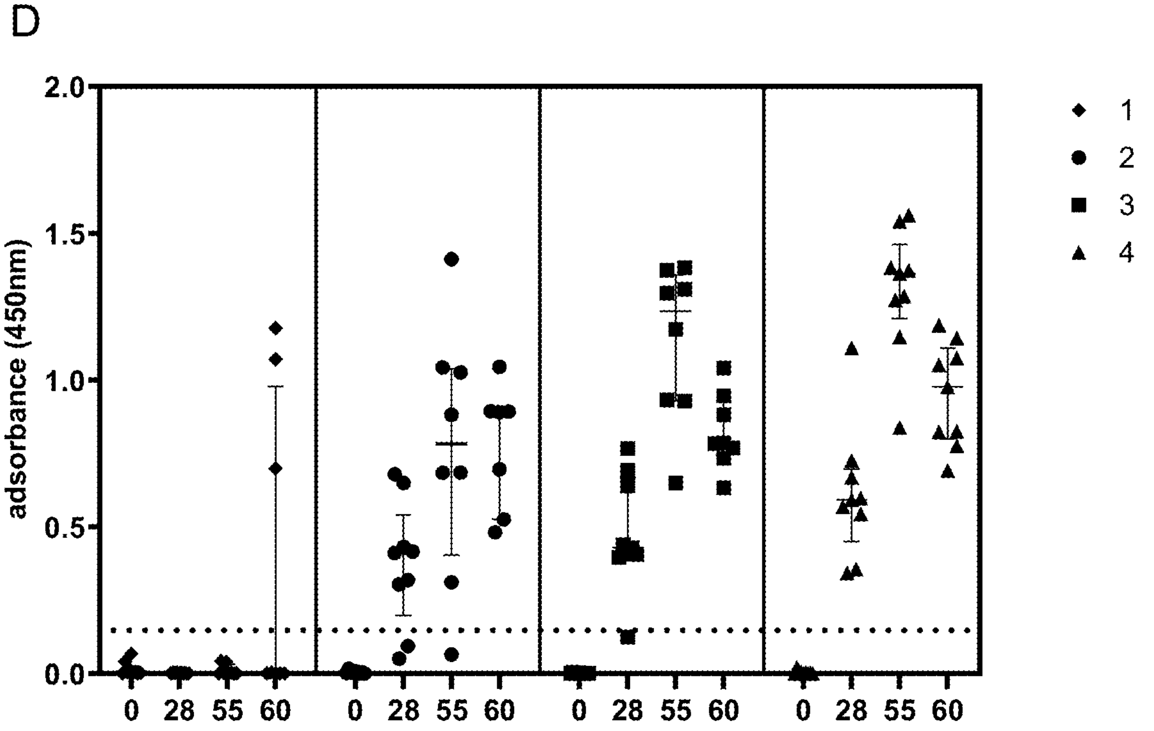
Figure 15:
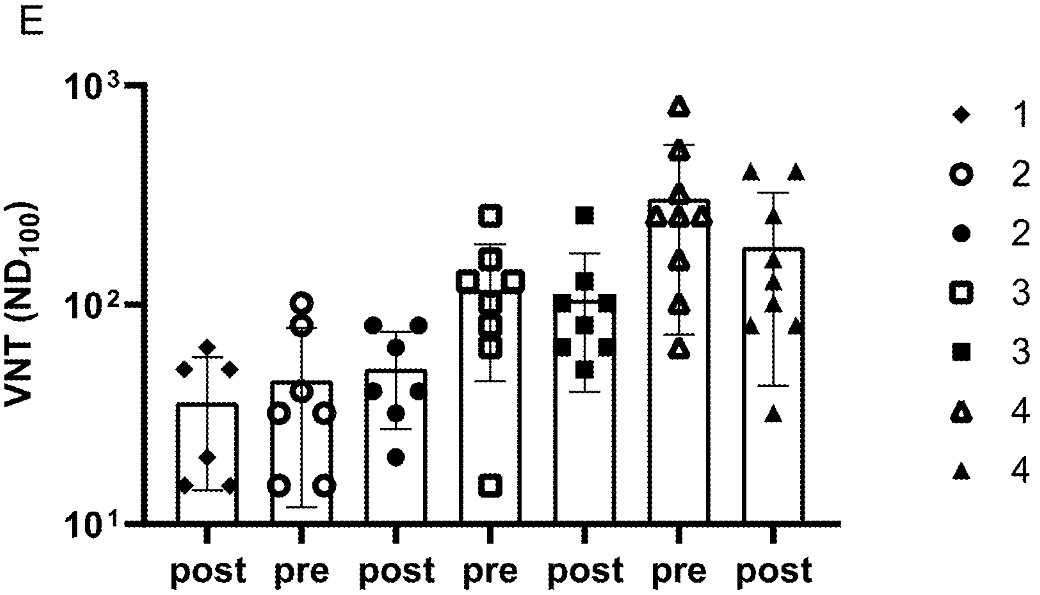

FIG. 15 shows vaccine efficacy in with SARS-CoV-2 variant B.1.351 challenged hamsters. FIG. 15A demonstrate the percentage body weight changes in days post challenge infection. Viral RNA load in saliva is shown in FIG. 15 B and in lung tissues in FIG. 15 C. FIG. 15 D demonstrates induction of anti-RBD total immunoglobulins (Ig) and FIG. 15 E VNTs.

DEFINITIONS

For the sake of clarity and readability, the following definitions are provided. Any technical feature mentioned for these definitions may be read on each and every embodiment of the invention. Additional definitions and explanations may be specifically provided in the context of these embodiments.

Percentages in the context of numbers should be understood as relative to the total number of the respective items. In other cases, and unless the context dictates otherwise, percentages should be understood as percentages by weight (wt.-%).

About: The term "about" is used when determinants or values do not need to be identical, i.e. 100% the same. Accordingly, "about" means, that a determinant or values may diverge by 0.1% to 20%, or 0.1% to 10%, including any point within these ranges; e.g. by 0.1%, 0.2%, 0.3% 0.4%, 0.5%, 0.6%, 0.7%, 0.8%, 0.9%, 1%, 2%, 3%, 4%, 5%, 6%, 7%, 8%, 9%, 10%, 11%, 12%, 13%, 14%, 15%, 16%, 17%, 18%, 19%, 20%. The skilled person will know that e.g. certain parameters or determinants may slightly vary based on the method how the parameter was determined. For example, if a certain determinants or value is defined herein to have e.g. a length of "about 1000 nucleotides", the length may diverge by 0.1% to 20%, or 0.1% to 10%, including any point within these ranges; e.g. by 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 11%, 12%, 13%, 14%, 15%, 16%, 17%, 18%, 19%, 20%. Accordingly, the skilled person will know that in that specific examples the length may diverge by 1 to 200 nucleotides, or by 1 to 100 nucleotides; in particular, by 1, 2, 3, 4, 5, 10, 20, 30, 40, 50, 60, 70, 80, 90, 100, 110, 120, 130, 140, 150, 160, 170, 180, 190, 200 nucleotides, or any integer value within the range.

Adaptive immune response: The term "adaptive immune response" as used herein will be recognized and understood by the person of ordinary skill in the art, and is e.g. intended to refer to an antigen-specific response of the immune system (the adaptive immune system). Antigen specificity allows for the generation of responses that are tailored to specific pathogens or pathogen-infected cells. The ability to mount these tailored responses is usually maintained in the body by "memory cells" (B-cells). In the context of the invention, the antigen is provided by an RNA encoding at least one antigenic peptide or protein derived from SARS-CoV-2, e.g. from a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), 6.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia). Preferably the antigen is provided by an RNA encoding at least one antigenic peptide derived from a SARS-CoV-2 spike protein, e.g. comprising a spike protein from derived from a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia)

Antigen: The term "antigen" as used herein will be recognized and understood by the person of ordinary skill in the art, and is e.g. intended to refer to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein, which may be presented by the MHC to T-cells. Also fragments, variants and derivatives of peptides or proteins derived from e.g. spike protein (S) of SARS-CoV-2, e.g. from a spike protein (S) of a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia) comprising at least one epitope are understood as antigens in the context of the invention. In the context of the present invention, an antigen may be the product of translation of a provided RNA as specified herein.

Antigenic peptide or protein: The term "antigenic peptide or protein" or "immunogenic peptide or protein" will be recognized and understood by the person of ordinary skill in the art, and is e.g. intended to refer to a peptide, protein derived from a (antigenic or immunogenic) protein which stimulates the body's adaptive immune system to provide an adaptive immune response. Therefore, an antigenic/immunogenic peptide or protein comprises at least one epitope or antigen of the protein it is derived from (e.g., spike protein (S) of SARS-CoV-2), e.g. derived from a spike protein (S) from a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/6.1.429 (Epsilon, Calif., US), B.1.525 (Eta, Nigeria), B.1.258

(Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

Cationic: Unless a different meaning is clear from the specific context, the term "cationic" means that the respective structure bears a positive charge, either permanently or not permanently, but in response to certain conditions such as pH. Thus, the term "cationic" covers both "permanently cationic" and "cationisable".

Cationisable: The term "cationisable" as used herein means that a compound, or group or atom, is positively charged at a lower pH and uncharged at a higher pH of its environment. Also in non-aqueous environments where no pH value can be determined, a cationisable compound, group or atom is positively charged at a high hydrogen ion concentration and uncharged at a low concentration or activity of hydrogen ions. It depends on the individual properties of the cationisable or polycationisable compound, in particular the pKa of the respective cationisable group or atom, at which pH or hydrogen ion concentration it is charged or uncharged. In diluted aqueous environments, the fraction of cationisable compounds, groups or atoms bearing a positive charge may be estimated using the so-called Henderson-Hasselbalch equation, which is well-known to a person skilled in the art. E.g., in some embodiments, if a compound or moiety is cationisable, it is preferred that it is positively charged at a pH value of about 1 to 9, preferably 4 to 9, 5 to 8 or even 6 to 8, more preferably of a pH value of or below 9, of or below 8, of or below 7, most preferably at physiological pH values, e.g. about 7.3 to 7.4, i.e. under physiological conditions, particularly under physiological salt conditions of the cell in vivo. In other embodiments, it is preferred that the cationisable compound or moiety is predominantly neutral at physiological pH values, e.g. about 7.0-7.4, but becomes positively charged at lower pH values. In some embodiments, the preferred range of pKa for the cationisable compound or moiety is about 5 to about 7.

Coding sequence/coding region: The terms "coding sequence" or "coding region" and the corresponding abbreviation "cds" as used herein will be recognized and understood by the person of ordinary skill in the art, and are e.g. intended to refer to a sequence of several nucleotide triplets, which may be translated into a peptide or protein. A coding sequence in the context of the present invention may be an RNA sequence consisting of a number of nucleotides that may be divided by three, which starts with a start codon and which preferably terminates with a stop codon.

Derived from: The term "derived from" as used throughout the present specification in the context of a nucleic acid, i.e. for a nucleic acid "derived from" (another) nucleic acid, means that the nucleic acid, which is derived from (another) nucleic acid, shares e.g. at least 60%, 70%, 80%, 81%, 82%, 83%, 84%, 85%, 86%, 87%, 88%, 89%, 90%, 91%, 92%, 93%, 94%, 95%, 96%, 97%, 98%, or 99% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the T by U throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. In the context of amino acid sequences (e.g. antigenic peptides or proteins) the term "derived from" means that the amino acid sequence, which is derived from (another) amino acid sequence, shares e.g. at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% sequence identity with the amino acid sequence from which it is derived.

Epitope: The term "epitope" (also called "antigen determinant" in the art) as used herein will be recognized and understood by the person of ordinary skill in the art, and is e.g. intended to refer to T cell epitopes and B cell epitopes. T cell epitopes or parts of the antigenic peptides or proteins and may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 to about 20 or even more amino acids. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context epitopes can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment: The term "fragment" as used throughout the present specification in the context of a nucleic acid sequence (e.g. RNA or a DNA) or an amino acid sequence may typically be a shorter portion of a full-length sequence of e.g. a nucleic acid sequence or an amino acid sequence, while still retaining its intended function. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% of the total (i.e. full-length) molecule from which the fragment is derived (e.g. spike protein (S) of SARS-CoV-2, e.g. from spike protein (S) of a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia)). The term "fragment" as used throughout the present specification in the context of proteins or peptides may, typically, comprise a sequence of a protein or peptide as defined herein, which is, with regard to its amino acid sequence, N-terminally and/or C-terminally truncated compared to the amino acid sequence of the original protein. Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. Fragments of proteins or peptides may comprise at least one epitope of those proteins or peptides.

Heteroloqous: The terms "heterologous" or "heterologous sequence" as used throughout the present specification in the context of a nucleic acid sequence or an amino acid sequence refers to a sequence (e.g. RNA, DNA, amino acid) has to be understood as a sequence that is derived from another gene, another allele, or e.g. another species or virus. Two sequences are typically understood to be "heterologous" if they are not derivable from the same gene or from the same allele. I.e., although heterologous sequences may be derivable from the same organism or virus, in nature, they do not occur in the same nucleic acid or protein.

Humoral immune response: The terms "humoral immunity" or "humoral immune response" will be recognized and understood by the person of ordinary skill in the art, and are e.g. intended to refer to B-cell mediated antibody production and optionally to accessory processes accompanying antibody production. A humoral immune response may be typically characterized, e.g. by Th2 activation and cytokine production, germinal center formation and isotype switching, affinity maturation and memory cell generation. Humoral immunity may also refer to the effector functions of antibodies, which include pathogen and toxin neutralization, classical complement activation, and opsonin promotion of phagocytosis and pathogen elimination.

Identity (of a sequence): The term "identity" as used throughout the present specification in the context of a nucleic acid sequence or an amino acid sequence will be recognized and understood by the person of ordinary skill in the art, and is e.g. intended to refer to the percentage to which two sequences are identical over the full/entire length thereof or over a specific designated portion, region or domain thereof. For example, there is at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% identity over the full/entire length thereof or over a specific designated portion, region or domain thereof. To determine the percentage to which two sequences are identical, e.g. nucleic acid sequences or amino acid (aa) sequences as defined herein, preferably the aa sequences encoded by the nucleic acid sequence as defined herein or the aa sequences themselves, the sequences can be aligned in order to be subsequently compared to one another. Therefore, e.g. a position of a first sequence may be compared with the corresponding position of the second sequence. If a position in the first sequence is occupied by the same residue as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using an algorithm, e.g. an algorithm integrated in the BLAST program.

Immunogen, immunogenic: The terms "immunogen" or "immunogenic" will be recognized and understood by the person of ordinary skill in the art, and are e.g. intended to refer to a compound that is able to stimulate/induce an immune response. Preferably, an immunogen may be a peptide, polypeptide, or protein. An immunogen in the sense of the present invention is the product of translation of a provided RNA comprising at least one coding sequence encoding at least one antigenic peptide, protein derived from spike protein of SARS-CoV-2, e.g. a protein derived from a spike protein of a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia) as defined herein. Typically, an immunogen elicits an adaptive immune response.

Immune response: The term "immune response" will be recognized and understood by the person of ordinary skill in the art, and is e.g. intended to refer to a specific reaction of the adaptive immune system to a particular antigen (so called specific or adaptive immune response) or an unspecific reaction of the innate immune system (so called unspecific or innate immune response), or a combination thereof. A suitable vaccine induces an efficient immune response in a normal healthy recipient to whom the vaccine is administered. With an efficient immune response one vaccination will result in virus-neutralizing antibody titers. In addition, or alternatively, an efficient immune response will elicit an adaptive immune response. In some embodiments the efficient immune response will reduce coronavirus infection by at least 50% relative to a neutralizing antibody titer of an unvaccinated control subject. In some embodiments, an efficient immune response will be one where the neutralizing antibody titer and/or a T cell immune response is sufficient to reduce the rate of asymptomatic viral infection relative to the neutralizing antibody titer of unvaccinated control subjects. An efficient immune response may also be one where the neutralizing antibody titer and/or a T cell immune response is sufficient to prevent viral latency in the subject and/or the neutralizing antibody titer is sufficient to block fusion of virus with epithelial cells of the subject. In some embodiments an efficient immune response is one in which administration of a therapeutically effective amount of the nucleic acid, the composition, the polypeptide, or the vaccine to a subject induces a T cell immune response against coronavirus in the subject. In preferred embodiments, the T cell immune response comprises a CD4+ T cell immune response and/or a CD8+ T cell immune response. In further aspects, an efficient immune response is one in which the immune response protects the subject from severe COVID-19 disease for at least about 6 months and/or reduce the incidence of hospitalization compared to an unvaccinated person. An efficient immune response may also reduce the transmission of virus due compared to transmission from an unvaccinated person infected with the virus. An efficient immune response may also be considered as one which provide some protection against variants due to heterologous immune responses.

Immune system: The term “immune system” will be recognized and understood by the person of ordinary skill in the art, and is e.g. intended to refer to a system of the organism that may protect the organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Innate immune system: The term “innate immune system” (also known as non-specific or unspecific immune system) will be recognized and understood by the person of ordinary skill in the art, and is e.g. intended to refer to a system typically comprising the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be activated by ligands of pattern recognition receptor e.g. Toll-like receptors, NOD-like receptors, or RIG-I like receptors etc.

Lipidoid compound: A lipidoid compound, also referred to as lipidoid, is a lipid-like compound, i.e. an amphiphilic compound with lipid-like physical properties. In the context of the present invention, the term lipid is considered to encompass lipidoid compounds.

Permanently cationic: The term “permanently cationic” as used herein will be recognized and understood by the person of ordinary skill in the art, and means, e.g., that the respective compound, or group, or atom, is positively charged at any pH value or hydrogen ion activity of its environment. Typically, the positive charge results from the presence of a quaternary nitrogen atom. Where a compound carries a plurality of such positive charges, it may be referred to as permanently polycationic.

RNA sequence: The term “RNA sequence” will be recognized and understood by the person of ordinary skill in the art, and e.g. refer to a particular and individual order of the succession of its ribonucleotides.

Stabilized RNA: The term “stabilized RNA” refers to an RNA that is modified such that it is more stable to disintegration or degradation, e.g., by environmental factors or enzymatic digest, such as by exo- or endonuclease degradation, compared to an RNA without such modification. Preferably, a stabilized RNA in the context of the present invention is stabilized in a cell, such as a prokaryotic or eukaryotic cell, preferably in a mammalian cell, such as a human cell. The stabilization effect may also be exerted outside of cells, e.g. in a buffer solution etc., e.g., for storage of a composition comprising the stabilized RNA.

T-cell responses: The terms “cellular immunity” or “cellular immune response” or “cellular T-cell responses” as used herein will be recognized and understood by the person of ordinary skill in the art, and are for example intended to refer to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface.

UTR: The term “untranslated region” or “UTR” or “UTR element” will be recognized and understood by the person of ordinary skill in the art, and are e.g. intended to refer to a part of a nucleic acid molecule typically located 5' or 3' located of a coding sequence. An UTR is not translated into protein. An UTR may be part of a nucleic acid, e.g. a DNA or an RNA. An UTR may comprise elements for controlling gene expression, also called regulatory elements. Such regulatory elements may be, e.g., ribosomal binding sites, miRNA binding sites etc.

3'-UTR: The term “3'-untranslated region” or “3'-UTR” or “3'-UTR element” will be recognized and understood by the person of ordinary skill in the art, and are e.g. intended to refer to a part of a nucleic acid molecule located 3' (i.e. downstream) of a coding sequence and which is not translated into protein. A 3'-UTR may be part of an RNA, located between a coding sequence and an (optional) poly(A) sequence. A 3'-UTR may comprise elements for controlling gene expression, also called regulatory elements. Such regulatory elements may be, e.g., ribosomal binding sites, miRNA binding sites etc.

5'-UTR: The term “5'-untranslated region” or “5'-UTR” or “5'-UTR element” will be recognized and understood by the person of ordinary skill in the art, and are e.g. intended to refer to a part of a nucleic acid molecule located 5' (i.e. upstream) of a coding sequence and which is not translated into protein. A 5'-UTR may be part of an RNA, located between a coding sequence and an (optional) 5' cap. A 5'-UTR may comprise elements for controlling gene expression, also called regulatory elements. Such regulatory elements may be, e.g., ribosomal binding sites, miRNA binding sites etc.

Variant (of a sequence): The term “variant” as used throughout the present specification in the context of a nucleic acid sequence will be recognized and understood by the person of ordinary skill in the art, and is e.g. intended to refer to a variant of a nucleic acid sequence derived from another nucleic acid sequence. E.g., a variant of a nucleic acid sequence may exhibit one or more nucleotide deletions, insertions, additions and/or substitutions compared to the nucleic acid sequence from which the variant is derived. A variant of a nucleic acid sequence may at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% identical to the nucleic acid sequence the variant is derived from. The variant is a functional variant in the sense that the variant has retained at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% or more of the function of the sequence where it is derived from. In one embodiment a "variant" of a nucleic acid sequence may have at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% nucleotide identity over a stretch of at least 10, 20, 30, 50, 75 or 100 nucleotide of such nucleic acid sequence.

The term "variant" as used throughout the present specification in the context of proteins or peptides is e.g. intended to refer to a proteins or peptide variant having an amino acid sequence which differs from the original sequence in one or more mutation(s)/substitution(s), such as one or more substituted, inserted and/or deleted amino acid(s). For example, in some aspects an insertion in a protein sequence comprises an insertion of 1 to 10 amino acids, such 1, 2, 3, 4, 5, 6, 7 8, 9 or 10 consecutive amino acids. Preferably, these fragments and/or variants may have the same, or a comparable specific antigenic property (immunogenic variants, antigenic variants). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra). A "variant" of a protein or peptide may have at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% amino acid identity over a stretch of at least 10, 20, 30, 50, 75 or 100 amino acids or over the entire length of such protein or peptide. Preferably, a variant of a protein may comprise a functional variant of the protein, which means, in the context of the invention, that the variant exerts essentially the same, or at least 40%, 50%, 60%, 70%, 75%, 80%, 85%, 90%, 95%, 98% or more of the immunogenicity as the protein it is derived from.

Short Description of the Invention

The present invention is based, in part, on the finding that RNA encoding spike proteins derived from SARS-CoV-2 variants can be efficiently expressed in human cells and induce an antibody response in animals that broadly neutralizes different SARS-CoV-2 variants, e.g. a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), 6.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia). Moreover, mixtures of RNA encoding different SARS-CoV-2 spike protein variants are also shown to be effective in producing neutralizing antibodies to a range of SARS-CoV-2 variants. These findings provide basis for new RNA-based coronavirus vaccines.

RNA sequences, composition, or vaccines as described herein have at least some of the following advantageous features:

- Translation of the RNA at the site of injection/vaccination (e.g. muscle);
- Very efficient induction of antigen-specific immune responses against the encoded SARS-CoV-2 protein at a very low dosage and dosing regimen;
- Suitability for vaccination of infants and/or newborns or the elderly, in particular the elderly;
- Suitability of the composition/vaccine for intramuscular administration;
- Induction of specific and functional humoral immune response against SARS-CoV-2 variants;
- Induction of broad, functional cellular T-cell responses against SARS-CoV-2 variants;
- Induction of specific B-cell memory against SARS-CoV-2 variants;
- Induction of functional antibodies that can effectively neutralize the SARS-CoV-2 virus variants;
- Induction of functional antibodies that can also effectively neutralize the original SARS-CoV-2 virus;
- Eliciting of mucosal IgA immunity by inducing of mucosal IgA antibodies;
- Induction of a well-balanced B cell and T cell responses;
- Induction of protective immunity against SARS-CoV-2 variants;
- Fast onset of immune protection against SARS-CoV-2 variants;
- Longevity of the induced immune responses against SARS-CoV-2 variants;
- No enhancement of a SARS-CoV-2 infection due to vaccination or immunopathological effects;
- No antibody dependent enhancement (ADE) caused by the RNA based SARS-CoV-2 vaccine;
- No excessive induction of systemic cytokine or chemokine response after application of the vaccine, which could lead to an undesired high reactogenicity upon vaccination;
- Well tolerability, no side-effects, non-toxicity of the vaccine;
- Advantageous stability characteristics of the RNA-based vaccine;
- Speed, adaptability, simplicity and scalability of SARS-CoV-2 variant vaccine production;
- Advantageous vaccination regimen that only requires one or two vaccination for sufficient protection;
- Advantageous vaccination regimen that only requires a low dose of the vaccine for sufficient protection;
- Advantageous vaccination regimen that only requires a low dose of the composition/vaccine for sufficient protection which allows the combination of different antigen providing RNAs for multivalent vaccines;
- Boostability of an existing immunity against SARS-CoV-2, preferably inducing additional immune responses against SARS-CoV-2 variants;
- Induction of different, SARS-CoV-2 strain specific immune responses in subjects that have been exposed to a different a strain or that have been vaccinated with a vaccine against a different strain;
- Induction of a broad immune response across various SARS-CoV-2 variants;

In a first aspect, the present invention provides an RNA encoding at least one SARS-CoV-2 spike protein or an immunogenic fragment or immunogenic variant thereof, wherein the SARS-CoV-2 spike protein comprises at least one amino acid substitution, deletion or insertion at a position corresponding to H69; V70; A222; Y453; S477; I692; R403; K417; N437; N439; V445; G446; L455; F456; K458; A475; G476; T478; E484; G485, F486; N487; Y489; F490; Q493; S494; P499; T500; N501; V503; G504; Y505; Q506; Y144; A570; P681; T716; S982; D1118; L18; D80; D215; L242; A243; L244; R246; A701; T20; P26; D138; R190; H655; T1027; S13; W152; L452; R346; P384; G447; G502; T748; A522; V1176; T859; S247; Y248; L249; T250; P251; G252; G75; T76; D950; E154; G769; S254; Q613; F157; R158; Q957; D253; T95; F888; Q677; A67; Q414; N450; V483; G669; T732; Q949; Q1071; E1092; H1101; N1187; W258; T19; V126; H245; S12; A899; G142; E156; K558; and/or Q52 relative to the sequence of SEQ ID NO: 1, wherein the RNA comprises at least one heterologous untranslated region. In certain embodiments, the RNA encodes a SARS-CoV-2 spike protein that comprises at least one amino acid substitution, deletion or insertion at a position from a SARS-CoV-2 variant spike protein (e.g. from a SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

In a second aspect, the present invention provides a composition, preferably an immunogenic composition comprising at least one RNA of the first aspect. Suitably, the composition comprises at least one RNA of the first aspect formulated in lipid-based carriers, preferably in lipid nanoparticles (LNPs). In preferred embodiments, the second aspect relates to multivalent compositions, such as compositions comprising RNAs encoding SARS-CoV-2 spike proteins having different amino acid coding sequences (e.g., spike proteins from more than one SARS-CoV-2 strain, including more than one SARS-CoV-2 variant strain, e.g. spike proteins from more than one more SARS-Cov-2 strain including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia)).

In a third aspect, the present invention provides a SARS-CoV-2 variant vaccine, wherein the vaccine comprises at least one RNA of the first aspect, or at least one composition of the second aspect. In preferred embodiments, the second aspect relates to multivalent SARS-CoV-2 vaccines. In preferred embodiments, the third aspect relates to SARS-CoV-2 variant booster vaccines. The SARS-CoV-2 variant booster vaccines may be for one or more SARS-Cov-2 strains including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia)

In a fourth aspect, the present invention provides a kit or kit of parts comprising at least one RNA of the first aspect, and/or at least one composition of the second aspect, and/or at least one SARS-CoV-2 variant vaccine of the third aspect.

In a fifth aspect, the present invention provides a combination comprising at least two separate components, wherein the at least two separate components are each RNA species of the first aspect, and/or compositions of the second aspect, and/or SARS-CoV-2 variant vaccines of the third aspect, i.e. each component is a RNA species, composition and/or SARS-Cov-2 variant vaccine directed to a different SARS-Cov-2, wherein said two separate components may be each directed to a SARS-Cov-2 variant including, but not limited to: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/6.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

Further aspects of the invention concern a method of treating or preventing a SARS-CoV-2 infection in a subject, and first and second medical uses of nucleic acid, compositions, and vaccines. Also provided are methods of manufacturing the nucleic acid, the composition, or the vaccine.

DETAILED DESCRIPTION OF THE INVENTION

The present application is filed together with a sequence listing in electronic format, which is part of the description of the present application (WIPO standard ST.25). The information contained in the sequence listing is incorporated herein by reference in its entirety. Where reference is made herein to a "SEQ ID NO", the corresponding nucleic acid sequence or amino acid (aa) sequence in the sequence listing having the respective identifier is referred to. For many sequences, the sequence listing also provides additional detailed information, e.g. regarding certain structural features, sequence optimizations, GenBank (NCBI) or GISAID (epi) identifiers, or additional detailed information regarding its coding capacity. In particular, such information is provided under numeric identifier <223> in the WIPO standard ST.25 sequence listing. Accordingly, information provided under said numeric identifier <223> is explicitly included herein in its entirety and has to be understood as integral part of the description of the underlying invention.

RNA Suitable for a SARS-CoV-2 Variant Vaccine:

In a first aspect, the invention relates to an RNA suitable for a SARS-CoV-2 variant vaccine.

It has to be noted that specific features and embodiments that are described in the context of the first aspect of the invention, that is the RNA of the invention, are likewise applicable to the second aspect (composition of the invention), the third aspect (vaccine of the invention), the fourth aspect (kit or kit of parts of the invention), the fifth aspect (combination of the invention), or further aspects including medical uses and method of treatments.

The RNA of the first aspect forms the basis for an RNA based composition or vaccine. Generally, protein-based vaccines, or live attenuated vaccines, are suboptimal for use in developing countries due to their high production costs. In addition, protein-based vaccines, or live attenuated vaccines require long development times and are not suitable for rapid responses of pandemic virus outbreaks such as the SARS-CoV-2 outbreak in 2019/2020. In contrast, RNA-based vaccines according to the present invention allow very fast and cost-effective production. Therefore, in comparison with known vaccines, vaccine based on the inventive RNA can be produced significantly cheaper and faster, which is very advantageous particularly for use in developing countries. One further advantage of a vaccine based on RNA may be its temperature-stability in comparison to protein or peptide-based vaccines.

In particularly preferred embodiments, the first aspect of the invention relates to an RNA comprising at least one coding sequence encoding at least one antigenic peptide or protein from a SARS-CoV-2 spike protein or an immunogenic fragment or immunogenic variant thereof, wherein the RNA comprises at least one heterologous untranslated region (UTR) and wherein the SARS-CoV-2 spike protein comprises at least one amino acid substitution selected from a SARS-CoV-2 variant and optionally a stabilizing mutation of a SARS-Co-2 strain.

The term "antigenic peptide or protein from a SARS-CoV-2 spike protein" herein means (i) an antigen that is a SARS-CoV-2 spike protein having amino acid sequence of the antigenic peptide or protein (or a fragment thereof) which is identical to a SARS-CoV-2 variant protein (or a fragment thereof), or (ii) an antigen that is derived from a SARS-CoV-2 spike protein having an amino acid sequence of the antigenic peptide or protein (or a fragment thereof) which is not identical to a corresponding SARS-CoV-2 variant protein (or a fragment thereof). For example, the respective SARS-CoV-2 spike protein may comprise at least one amino acid substitution, insertion or deletion selected from a SARS-CoV-2 variant and/or at least one pre-fusion stabilizing mutation.

The term "immunogenic fragment" or "immunogenic variant" herein means any fragment/variant of the corresponding SARS-CoV-2 antigen that is capable of raising an immune response in a subject. Preferably, intramuscular or intradermal administration of the RNA of the first aspect results in expression of the encoded SARS-CoV-2 spike protein in a subject.

The term "expression" as used herein refers to the production of a SARS-CoV-2 spike protein, wherein said SARS-CoV-2 spike protein is provided by a coding sequence of an RNA of the first aspect. For example, "expression" of an RNA refers to production of a protein (e.g. after administration of said RNA to a cell or a subject) via translation of the RNA into a polypeptide, e.g. into a peptide or protein that is or is derived from a SARS-CoV-2 coronavirus. The term "expression" and the term "production" may be used interchangeably herein. Further, the term "expression" preferably relates to production of a certain peptide or protein upon administration of an RNA to a cell or an organism.

In preferred embodiments, the RNA of the invention is suitable for a SARS-CoV-2 variant vaccine.

A SARS-CoV-2 Spike protein is a type I viral fusion protein that exists as trimer on the viral surface with each monomer consisting of a Head (S1) and stem (S2). Individual precursor S polypeptides form a homotrimer and undergo glycosylation within the Golgi apparatus as well as processing to remove the signal peptide, and cleavage by a cellular protease to generate separate S1 and S2 polypeptide chains, which remain associated as S1/S2 protomers within the homotrimer and is therefore a trimer of heterodimers. The S1 domain of the spike glycoprotein includes the receptor binding domain (RBD) that engages (most likely) with the angiotensin-converting enzyme 2 receptors and mediates viral fusion into the host cell, an N-terminal domain that may make initial contact with target cells, and 2 subdomains, all of which are susceptible to neutralizing antibodies. S2 domain consists of a six helix bundle fusion core involved in membrane fusion with the host endosomal membrane and is also a target for neutralization. The S2 subunit further comprises two heptad-repeat sequences (HR1 and HR2) and a central helix typical of fusion glycoproteins, a transmembrane domain, and the cytosolic tail domain.

In the context of the invention, any Spike protein that is selected from or is derived from a SARS-CoV-2 variant and comprises least one amino acid substitution, deletion or insertion when compared to SEQ ID NO:1 may be used and may be suitably encoded by the coding sequence or the RNA of the first aspect. It is further in the scope of the underlying invention, that the at least one antigenic peptide or protein may comprise or consist of a synthetically engineered or an artificial SARS-CoV-2 spike protein. The term "synthetically engineered" SARS-CoV-2 spike protein, or the term "artificial SARS-CoV-2 spike protein" or the term "recombinant" SARS-CoV-2 spike protein relates to a protein that does not occur in nature. Accordingly, an "artificial SARS-CoV-2 spike protein" or a "synthetically engineered SARS-CoV-2 spike protein" or the term "recombinant" SARS-CoV-2 spike protein may, for example, differ in at least one amino acid compared to a naturally occurring SARS-CoV-2 spike protein (e.g., comprising one or more heterologous/introduced amino acids as compared to a naturally occurring SARS-CoV-2 spike protein), and/or may comprise an additional heterologous peptide or protein element, and/or may be N-terminally or C-terminally extended or truncated.

In the following, preferred antigenic peptide or protein sequences that are provided by the RNA of the invention are described in detail.

It should be noted that where reference is made to amino acid (aa) residues and their position in a SARS-CoV-2 spike protein (S), any numbering used herein—unless stated otherwise—relates to the position of the respective amino acid residue in a corresponding spike protein (S) of the original SARS-CoV-2 coronavirus isolate EPI_ISL_402128 according to SEQ ID NO: 1. Respective amino acid positions are, throughout the disclosure, exemplarily indicated for spike protein (S) of the original SARS-CoV-2 coronavirus isolate EPI_ISL_402128 (SEQ ID NO: 1).

Protein annotation as used herein relates to SEQ ID NO: 1 as a reference protein. The full-length spike protein (S) of the original SARS-CoV-2 coronavirus reference protein has 1273 amino acid residues, and comprises the following elements:

secretory signal peptide: amino acid position aa 1 to aa 15 (see SEQ ID NO: 28)

spike protein fragment 51: amino acid position aa 1 to aa 681 (see SEQ ID NO: 27)

S1-N-Terminal Domain (S1-NTD) amino acid position aa 13 to aa 303 (see SEQ ID NO: 26992)

receptor binding domain (RBD): amino acid position aa 319 to aa 541 (see SEQ ID NO: 13243)

critical neutralisation domain (CND): amino acid position aa 329 to aa 529 (see SEQ ID NO: 13310)

spike protein fragment S2: amino acid position aa 682 to aa 1273 (see SEQ ID NO: 30)

transmembrane domain (TM) amino acid position aa 1212 to aa 1273 (see SEQ ID NO: 49)

transmembrane domain (TMflex) amino acid position aa 1148 to aa 1273 (see SEQ ID NO: 13176)

Furine cleavage site region (S1/S2) amino acid position aa 681 to aa 685 (see SEQ ID NO: 26994)

It should be noted that variation on an amino acid level naturally occurs between spike proteins derived from different SARS-CoV-2 isolates or SARS-CoV-2 variants. In the context of the invention, such amino acid variations can be applied to antigenic peptide or protein derived from a spike protein as described herein. Suitably, the amino acid variations or mutations are selected in a way to 1) induce an immune response against the SARS-CoV-2 virus variant the substitution/mutation is derived from and/or (2) to produce an antigenic peptide or protein that is desirable for inducing an immune response (e.g., an antigenic peptide or protein derived from a spike protein and that is in a pre-fusion form).

Accordingly, in particularly preferred embodiments, the RNA of the invention comprises at least one coding sequence encoding at least one SARS-CoV-2 spike protein, or an immunogenic fragment or immunogenic variant thereof, wherein the SARS-CoV-2 spike protein comprises at least one amino acid substitution, deletion, or insertion selected from a SARS-CoV-2 variant.

In that context, the term "at least one amino acid substitution, deletion, or insertion selected from a SARS-CoV-2 variant" herein means at least one amino acid position in the SARS-CoV-2 spike protein (or fragment thereof) that is different to the original SARS-CoV-2 spike protein (according to the SEQ ID NO: 1 reference strain).

In preferred embodiments, the SARS-CoV-2 variant is selected from or is derived from the following SARS-CoV-2 lineages: C.1.2 (South Africa), 8.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

In particularly preferred embodiments, the SARS-CoV-2 variant is selected from or derived from the following SARS-CoV-2 lineages: B.1.351 (South Africa), P.1 (Brazil), B.1.617.1 (India), B.1.617.2 (India), B.1.617.3 (India), B.1.1.529 (Omicron, South Africa) (including BA.1_v1, BA.1_v0, B.1.1.529, BA.2, BA.1_v2, BA.1_v3, BA.1_v4, BA.1_v5).

Accordingly, each spike protein provided herein and contemplated as suitable antigen in the context of the invention may have one or more of the following amino acid variations or mutations (amino acid positions according to reference SEQ ID NO: 1) as provided in List 1. The variations or mutations provided below are derived from new emerging SARS-CoV-2 virus variants, and may be integrated into the spike protein that is encoded by the RNA of the invention:

List 1A: Amino Acid Positions for Substitutions Deletions and/or Insertions

H69; V70; A222; Y453; S477; I692; R403; K417; N437; N439; V445; G446; L455; F456; K458; A475; G476; T478; E484; G485, F486; N487; Y489; F490; Q493; S494; P499; T500; N501; V503; G504; Y505; Q506; Y144; A570; P681; T716; S982; D1118; L18; D80; D215; L242; A243; L244; R246; A701; T20; P26; D138; R190; H655; T1027; S13; W152; L452; R346; P384; G447; G502; T748; A522; V1176; T859; S247; Y248; L249; T250; P251; G252; G75; T76; D950; E154; G769; S254; Q613; F157; R158; Q957; D253; T95; F888; Q677; A67; Q414; N450; V483; G669; T732; Q949; Q1071; E1092; H1101; N1187; W258; T19; V126; H245; S12; A899; G142; E156; K558; G339; P9; C136; Y449; L24; P25; P26; A27; V213; S371; T376; D405; A701; 1210; D936; S939; R357; R682; R683; A684; R685; V143, Y144, Y145, N211, L212, R214, E241, G339, S371, S373, S375, N440, G496, Q498, Y505, T547, D614, N679, P681, N764, D796, N856, Q954, N969, L981 or Q52 (relative to the sequence of SEQ ID NO: 1).

List 1B: Amino Acid Substitutions Deletions or Insertions

H69del; V70del; A222V; Y453F; S477N; I692V; R403K; K417N; N437S; N439K; V445A; V4451; V445F; G446V; G446S; G446A; L455F; F456L; K458N; A475V; G476S; G476A; S477I; S477R; S477G; S477T; T4781; T478K; T478R; T478A; E484Q; E484K; E484A; E484D; G485R; G485S, F486L; N487I; Y489H; F490S; F490L; Q493L; Q493K; S494P; S494L; P499L; T5001; N501Y; N501T; N501S; V503F; V503I; G504D; Y505W; 0506K; 0506H; Y144del; A570D; P681H; T716I; S982A; D1118H; L18F; D80A; D215G; L242del; A243del; L244del; L242del; A243del; L244del; R246I; A701V; T20N; P26S; D138Y; R190S; H655Y; T1027I; S13I; W152C; L452R; R346T; P384L; L452M; F456A; F456K; F456V; E484P; K417T; G447V; L4520; A475S; F4861; F490Y; Q493R; S494A; P499H; P499S; G502V; T748K; A522S; V1176F; T859N; S247del; Y248del; L249del; T250del; P251del; G252del; R246del; S247del; Y248del; L249del; T250del; P251del; G252del; G75V; T761; G75V; T761; D950N; P681R; E154K; G769V; S254F; 0613H; F157L; F157del; R158del; Q957R; D253G; T95I; F888L; Q677H; A67V; 0414K; N450K; V483A; G669S; T732A; Q949R; Q1071H; E1092K; H1101Y; N1187D; W258L; V70F; T19R; T191; Y144T; Y145S; ins145N; R346K; R346S; V126A; H245Y; ins214TDR; S12F; W152R; A899S; G142D; E156G; K558N; P9L; C136F; Y449H; L24del; P25del; P26del; A27S; V213G; S371F; T376A; D405N; D253N; Y144S; 1210T; D936N; S939F; W152L; T201; R357K; D796H; Y145H; R682del; R683del; A684del; R685del; A701V; V143del, Y144del, Y145del, Y145N; N211del, L212del, L2121, ins214EPE, E241del, G339D, S371L, S373P, S375F, N440K, G496S, Q498R, Y505H; T547K, D614G, N679K, P681H, N764K, D796Y, N856K, Q954H, N969K, L981F or Q52R (relative to the sequence of SEQ ID NO: 1)

In a preferred embodiment there is provided a RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion at a position corresponding to H69; V70; A222; Y453; S477; I692; R403; K417; N437; N439; V445; G446; L455; F456; K458; A475; G476; T478; E484; G485, F486; N487; Y489; F490; Q493; S494; P499;

T500; N501; V503; G504; Y505; Q506; Y144; A570; P681; T716; S982; D1118; L18; D80; D215; L242; A243; L244; R246; A701; T20; P26; D138; R190; H655; T1027; S13; W152; L452; R346; P384; G447; G502; T748; A522; V1176; T859; S247; Y248; L249; T250; P251; G252; G75; T76; D950; E154; G769; S254; Q613; F157; R158; Q957; D253; T95; F888; Q677; A67; 0414; N450; V483; G669; T732; Q949; Q1071; E1092; H1101; N1187; W258; T19; V126; H245; S12; A899; G142; E156; K558; and/or Q52 relative to the sequence of SEQ ID NO: 1, wherein the RNA comprises at least one heterologous untranslated region. In certain aspects the RNA does not comprise a 3' UTR comprising the sequence of SEQ ID NO: 268. In certain aspects, the RNA comprises a 3' UTR comprising the sequence of SEQ ID NO: 268.

In particularly preferred embodiments, the SARS-CoV-2 spike protein comprises at least one amino acid substitution, deletion or insertion at a position corresponding to H69del; V70del; A222V; Y453F; S477N; I692V; R403K; K417N; N437S; N439K; V445A; V4451; V445F; G446V; G446S; G446A; L455F; F456L; K458N; A475V; G476S; G476A; S477I; S477R; S477G; S477T; T4781; T478K; T478R; T478A; E484Q; E484K; E484A; E484D; G485R; G485S, F486L; N487I; Y489H; F490S; F490L; Q493L; Q493K; S494P; S494L; P499L; T5001; N501Y; N501T; N501S; V503F; V503I; G504D; Y505W; 0506K; 0506H; Y144del; A570D; P681H; T716I; S982A; D1118H; L18F; D80A; D215G; L242del; A243del; L244del; L242del; A243del; L244del; R246I; A701V; T20N; P26S; D138Y; R190S; H655Y; T1027I; S13I; W152C; L452R; R346T; P384L; L452M; F456A; F456K; F456V; E484P; K417T; G447V; L4520; A475S; F4861; F490Y; Q493R; 5494A; P499H; P499S; G502V; T748K; A522S; V1176F; T859N; S247del; Y248del; L249del; T250del; P251del; G252del; R246del; S247del; Y248del; L249del; T250del; P251del; G252del; G75V; T761; G75V; T761; D950N; P681R; E154K; G769V; S254F; 0613H; F157L; F157del; R158del; Q957R; D253G; T95I; F888L; Q677H; A67V; 0414K; N450K; V483A; G669S; T732A; Q949R; 01071H; E1092K; H1101Y; N1187D; W258L; V70F; T19R; Y144T; Y145S; ins145N; R346K; R346S; V126A; H245Y; ins214TDR; S12F; W152R; A899S; G142D; E156G; K558N; and/or Q52R relative to the sequence of SEQ ID NO: 1.

In certain embodiments there is provided a RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion at a position corresponding to H69; V70; A222; Y453; S477; I692; R403; K417; N437; N439; V445; G446; L455; F456; K458; A475; G476; T478; E484; G485, F486; N487; Y489; F490; Q493; S494; P499; T500; N501; V503; G504; Y505; and/or Q506 relative to the sequence of SEQ ID NO: 1. Thus, in some embodiments the SARS-CoV-2 spike protein comprises at least one amino acid substitution, deletion or insertion at a position corresponding to H69del; V70del; A222V; Y453F; S477N; I692V; R403K; K417N; N437S; N439K; V445A; V4451; V445F; G446V; G446S; G446A; L455F; F456L; K458N; A475V; G476S; G476A; S477I; S477R; S477G; S477T; T4781; T478K; T478R; T478A; E484Q; E484K; E484A; E484D; G485R; G485S, F486L; N487I; Y489H; F490S; F490L; Q493L; Q493K; S494P; S494L; P499L; T5001; N501Y; N501T; N501S; V503F; V503I; G504D; Y505W; Q506K; and/or 0506H relative to the sequence of SEQ ID NO: 1.

In a further embodiment there is provided a RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion at a position corresponding to H69; V70; A222; Y453; S477; I692; R403; K417; N437; N439; V445; G446; L455; F456; K458; A475; G476; T478; E484; G485, F486; N487; Y489; F490; Q493; S494; P499; T500; N501; V503; G504; Y505; Q506; Y144; A570; P681; T716; S982; D1118; L18; D80; D215; L242; A243; L244; R246; A701; T20; P26; D138; R190; H655; T1027; S13; W152; L452; R346; P384; G447; G502; T748; A522; or V1176 relative to the sequence of SEQ ID NO: 1. Thus, in some embodiments the SARS-CoV-2 spike protein comprises at least one amino acid substitution, deletion or insertion at a position corresponding to H69del; V70del; A222V; Y453F; S477N; I692V; R403K; K417N; N437S; N439K; V445A; V4451; V445F; G446V; G446S; G446A; L455F; F456L; K458N; A475V; G476S; G476A; S477I; S477R; S477G; S477T; T4781; T478K; T478R; T478A; E484Q; E484K; E484A; E484D; G485R; G485S, F486L; N487I; Y489H; F490S; F490L; Q493L; Q493K; S494P; S494L; P499L; T5001; N501Y; N501T; N501S; V503F; V503I; G504D; Y505W; 0506K; 0506H; Y144del; A570D; P681H; T716I; S982A; D1118H; L18F; D80A; D215G; L242del; A243del; L244del; L242del; A243del; L244del; R246I; A701V; T20N; P26S; D138Y; R190S; H655Y; T1027I; S13I; W152C; L452R; R346T; P384L; L452M; F456A; F456K; F456V; E484P; K417T; G447V; L4520; A475S; F4861; F490Y; Q493R; S494A; P499H; P499S; G502V; T748K; A522S; and/or V1176F relative to the sequence of SEQ ID NO: 1.

In a further preferred embodiment, there is provided a RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion at a position corresponding to T859; R246; S247; Y248; L249; T250; P251; G252; G75; T76; D950; E154; G769; S254; Q613; F157; Q957; D253; T95; F888; Q677; A67; Q414; N450; V483; G669; T732; Q949; Q1071; E1092; H1101; N1187; F157; R158; W258; T19; H245; S12; A899; G142; E156; K558 and/or Q52 relative to the sequence of SEQ ID NO: 1. Thus, in some embodiments the SARS-CoV-2 spike protein comprises at least one amino acid substitution, deletion or insertion at a position corresponding to T859N; S247del; Y248del; L249del; T250del; P251del; G252del; R246del; S247del; Y248del; L249del; T250del; P251del; G252del; G75V; T761; G75V; T761; D950N; P681R; E154K; G769V; S254F; 0613H; F157L; Q957R; D253G; T95I; F888L; Q677H; A67V; 0414K; N450K; V483A; G669S; T732A; Q949R; Q1071H; E1092K; H1101Y; N1187D; F157del; R158del; W258L; V70F; T19R; Y144T; Y145S; ins145N; R346K; R346S; V126A; H245Y; ins214TDR; 512F; W152R; A899S; G142D; E156G; K558N and/or Q52R relative to the sequence of SEQ ID NO: 1.

In still a further embodiment there is provided an RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion at a position corresponding to D614; H49; V367; P1263; V483; S939; S943; L5; L8; S940; C1254; Q239; M153; V1040; A845; Y145; A831; and/or M1229 relative to the sequence of SEQ ID NO: 1.

Thus, in some embodiments the SARS-CoV-2 spike protein comprises at least one amino acid substitution, deletion or insertion at a position corresponding to D614G; H49Y; V367F; P1263L; V483A; S939F; S943P; L5F; L8V; 5940F; C1254F; Q239K; M153T; V1040F; A845S; Y145H; A831V; and/or M12291 relative to the sequence of SEQ ID NO: 1.

In still a further embodiment there is provided an RNA comprising at least one coding sequence encoding at least one SARS-CoV-2 spike protein or an immunogenic fragment or immunogenic variant thereof, wherein the SARS-CoV-2 spike protein comprises at least one amino acid substitution or deletion at a position corresponding to H69; V70; A222; Y453; S477; I692; R403; K417; N437; N439; V445; G446; L455; F456; K458; A475; G476; T478; E484; G485, F486; N487; Y489; F490; Q493; S494; P499; T500; N501; V503; G504; Y505; Q506; Y144; A570; P681; T716; S982; D1118; L18; D80; D215; L242; A243; L244; R246; A701; T20; P26; D138; R190; H655; T1027; S13; W152; L452; R346; P384; G447; G502; T748; A522; V1176; T859; S247; Y248; L249; T250; P251; G252; G75; T76; D950; E154; G769; S254; Q613; F157; Q957; D253; T95; F888; Q677; A67; Q414; N450; V483; G669; T732; Q949; Q1071; E1092; H1101; N1187 and/or Q52 relative to the sequence of SEQ ID NO: 1. Thus, in some embodiments the SARS-CoV-2 spike protein comprises at least one amino acid substitution or deletion at a position corresponding to H69del; V70del; A222V; Y453F; S477N; I692V; R403K; K417N; N437S; N439K; V445A; V4451; V445F; G446V; G446S; G446A; L455F; F456L; K458N; A475V; G476S; G476A; S477I; S477R; S477G; S477T; T4781; T478K; T478R; T478A; E484Q; E484K; E484A; E484D; G485R; G485S, F486L; N487I; Y489H; F490S; F490L; 0493L; Q493K; S494P; S494L; P499L; T5001; N501Y; N501T; N501S; V503F; V503I; G504D; Y505W; 0506K; 0506H; Y144del; A570D; P681H; T716I; S982A; D1118H; L18F; D80A; D215G; L242del; A243del; L244del; L242del; A243del; L244del; R246I; A701V; T20N; P26S; D138Y; R190S; H655Y; T1027I; S13I; W152C; L452R; R346T; P384L; L452M; F456A; F456K; F456V; E484P; K417T; G447V; L4520; A475S; F4861; F490Y; Q493R; 5494A; P499H; P499S; G502V; T748K; A522S; V1176F; T859N; S247del; Y248del; L249del; T250del; P251del; G252del; R246del; S247del; Y248del; L249del; T250del; P251del; G252del; G75V; T761; G75V; T761; D950N; P681R; E154K; G769V; S254F; 0613H; F157L; F157del; R158del; Q957R; D253G; T95I; F888L; Q677H; A67V; Q414K; N450K; V483A; G669S; T732A; Q949R; Q1071H; E1092K; H1101Y; N1187D; W258L; V70F; T19R; Y144T; Y145S; R346K; R346S; V126A; H245Y; 512F; W152R; A899S; G142D; E156G; K558N; and/or Q52R.

In a preferred embodiment there is provided an RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion at a position corresponding to T191; L24del; P25del; P26del; A27S; A67V; H69del; V70del; T95I; G142D; V143del; Y144del; Y145del; N211del; L2121; V213G; ins214EPE; G339D; S371L; S371F; S373P; S375F; T376A; D405N; K417N; N440K; G446S; S477N; T478K; E484A; Q493R; G496S; Q498R; N501Y; Y505H; T547K; D614G; H655Y; N679K; P681H; A701V; N764K; D796Y; N856K; Q954H; N969K; L981F relative to the sequence of SEQ ID NO: 1. Thus, in some embodiments the SARS-CoV-2 spike protein comprises at least one amino acid substitution, deletion or insertion at a position corresponding to T191; L24del; P25del; P26del; A27S; A67V; H69del; V70del; T95I; G142D; V143del; Y144del; Y145del; N211del; L2121; V213G; ins214EPE; G339D; 5371 L; S371F; S373P; S375F; T376A; D405N; K417N; N440K; G446S; S477N; T478K; E484A; Q493R; G496S; Q498R; N501Y; Y505H; T547K; D614G; H655Y; N679K; P681H; A701V; N764K; D796Y; N856K; Q954H; N969K; L981F relative to the sequence of SEQ ID NO: 1. In certain embodiments the SARS-CoV-2 spike protein is 90% identical to the amino acid sequence of SEQ ID NO: 10 and comprises at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 of the amino acid substitutions, deletions or insertions selected from the group consisting of T191; L24del; P25del; P26del; A27S; A67V; H69del; V70del; T95I; G142D; V143del; Y144del; Y145del; N211del; L2121; V213G; ins214EPE; G339D; 5371 L; S371F; S373P; S375F; T376A; D405N; K417N; N440K; G446S; S477N; T478K; E484A; Q493R; G496S; Q498R; N501Y; Y505H; T547K; D614G; H655Y; N679K; P681H; A701V; N764K; D796Y; N856K; Q954H; N969K; L981F relative to the sequence of SEQ ID NO: 1.

In yet a further embodiment there is provided an RNA comprising at least one coding sequence encoding at least one SARS-CoV-2 spike protein or an immunogenic fragment thereof, wherein the SARS-CoV-2 spike protein comprises at least one amino acid substitution, insertion or deletion corresponding to A67V, H69del, V70del, T95I, G142D, V143del, Y144del, Y145del, N211del, L2121, ins214EPE, G339D, 5371 L, S373P, S375F, S477N, T478K, E484A, Q493R, G496S, Q498R, N501Y, Y505H, T547K, D614G, H655Y, N679K, P681H, N764K, D796Y, N856K, Q954H, N969K and L981F.

In preferred embodiments, the SARS-CoV-2 spike protein comprises an amino acid substitution at a position located in the RBD domain (amino acid position aa 319 to aa 541; amino acid positions according to reference SEQ ID NO: 1) or the CND domain (amino acid position aa 329 to aa 529; amino acid positions according to reference SEQ ID NO: 1). Without wishing to be bound to theory, amino acid substitutions or mutations in the CND domain may help new emerging SARS-CoV-2 variants to evade antibody detection of some types of antibodies induced in subjects vaccinated with first generation vaccines (designed against the original SARS-CoV-2 strain) or induced in subjects after infection with the original SARS-CoV-2 strain.

Accordingly, in preferred embodiments, the first aspect of the invention relates to an RNA comprising at least one coding sequence encoding at least one antigenic peptide or protein from a SARS-CoV-2 spike protein or an immunogenic fragment or immunogenic variant thereof, wherein the RNA comprises at least one heterologous untranslated region (UTR) and wherein the SARS-CoV-2 spike protein comprises at least one amino acid substitution at position located in the RBD domain (amino acid position aa 319 to aa 541; amino acid positions according to reference SEQ ID NO: 1) or the CND domain (amino acid position aa 329 to aa 529 amino acid positions according to reference SEQ ID NO: 1).

In certain preferred embodiments, the SARS-CoV-2 spike protein comprises an amino acid substitution, insertion or deletion in at least one of the following positions: R346; V367, P384; R403; K417; N437; N439; V445; G446; G447; N450; L452; Y453; L455; F456; A475; G476; S477; T478; E484; G485; F486; N487; Y489; F490; Q493; S494; P499; T500; N501; G502; V503; G504; Y505; Q506; A522 (amino acid positions according to reference SEQ ID NO: 1).

Accordingly, in certain preferred embodiments, the first aspect of the invention relates to an RNA comprising at least one coding sequence encoding at least one antigenic peptide or protein from a SARS-CoV-2 spike protein or an immunogenic fragment or immunogenic variant thereof, wherein the SARS-CoV-2 spike protein comprises at least one amino acid substitution at positions selected from K417; L452; T478; E484; N501 and/or P681 (amino acid positions according to reference SEQ ID NO: 1) and wherein the RNA comprises at least one heterologous untranslated region (UTR).

Without wishing to be bound to theory, an amino acid substitution at position E484 may help SARS-CoV-2 virus variants to evade antibody detection of some types of antibodies induced in subjects vaccinated with first generation vaccines (designed against the original SARS-CoV-2 strain) or induced in subjects after infection with the original SARS-CoV-2 strain. A mutation/substitution in N501 occurs near the top of the coronavirus spike, where it may alter the shape of the protein, which may help to evade some types of coronavirus antibodies. Such SARS-CoV-2 are called SARS-CoV-2 E484 variants throughout the present invention and include e.g. SARS-CoV-2 B.1.351 (South Africa), SARS-CoV-2 B.1.617 (India), P.1 (Brazil) or B.1.1.529 (Omicron, South Africa) (including BA.1_v1, BA.1_v0, B.1.1.529, BA.2, BA.1_v2, BA.1_v3, BA.1_v4, BA.1_v5).

Accordingly, in some embodiments, it may be advantageous that the RNA of the invention provides a SARS-CoV-2 spike protein comprising a substitution in position E484 to allow the induction of efficient immune responses against virus SARS-CoV-2 E484 variants.

In preferred embodiments, the SARS-CoV-2 spike protein comprises an amino acid substitution at position E484, wherein the amino acids E484 is substituted with K, P, Q, A, or D (amino acid positions according to reference SEQ ID NO: 1). Accordingly, the antigenic peptide or protein selected from or derived from SARS-CoV-2 spike protein comprises a E484K, E484P, E484Q, E484A, E484D amino acid substitution.

In particularly preferred embodiments, the SARS-CoV-2 spike protein comprises an amino acid substitution at position E484, wherein the amino acids E484 is substituted with K or Q (amino acid positions according to reference SEQ ID NO: 1). Accordingly, the antigenic peptide or protein selected from or derived from SARS-CoV-2 spike protein comprises a E484K or E484Q amino acid substitution. In certain preferred embodiments a SARS-CoV-2 spike protein comprises a E484K amino acid substitution.

In preferred embodiments, the SARS-CoV-2 spike protein comprises an amino acid substitution at position N501, wherein the amino acids N501 is substituted with a different amino acid (amino acid positions according to reference SEQ ID NO: 1).

Without wishing to be bound to theory, an amino acid substitution at position N501 may help SARS-CoV-2 virus variants to evade antibody detection of some types of antibodies induced in subjects vaccinated with first generation vaccines (designed against the original SARS-CoV-2 strain) or induced in subjects after infection with the original SARS-CoV-2 strain. A mutation/substitution in N501 occurs near the top of the coronavirus spike, where it may alter the shape of the protein, which may help to evade some types of coronavirus antibodies. Such SARS-CoV-2 are called SARS-CoV-2 N501 variants throughout the present invention and include e.g. SARS-CoV-2 B.1.351 (South Africa), SARS-CoV-2 B.1.1.7 (UK), P.1 (Brazil), or B.1.1.529 (Omicron, South Africa) (including BA.1_v1, BA.1_v0, B.1.1.529, BA.2, BA.1_v2, BA.1_v3, BA.1_v4, BA.1_v5).

Accordingly it may be advantageous that the RNA of the invention provides a SARS-CoV-2 spike protein comprising a substitution in position N501 to allow the induction of efficient immune responses against virus SARS-CoV-2 N501 variants.

In preferred embodiments, the SARS-CoV-2 spike protein comprises an amino acid substitution at position N501, wherein the amino acids N501 is substituted with Y, T, S (amino acid positions according to reference SEQ ID NO: 1). Accordingly, the antigenic peptide or protein selected from or derived from SARS-CoV-2 spike protein comprises a N501Y, N501T, N501S amino acid substitution.

In particularly preferred embodiments, the SARS-CoV-2 spike protein comprises an amino acid substitution at position N501, wherein the amino acids N501 is substituted with Y (amino acid positions according to reference SEQ ID NO: 1). Accordingly, the antigenic peptide or protein selected from or derived from SARS-CoV-2 spike protein comprises a N501Y amino acid substitution.

In preferred embodiments, the SARS-CoV-2 spike protein comprises an amino acid substitution at position K417, wherein the amino acids K417 is substituted with a different amino acid (amino acid positions according to reference SEQ ID NO: 1).

Without wishing to be bound to theory, an amino acid substitution at position K417 may help SARS-CoV-2 virus variants to evade antibody detection of some types of antibodies induced in subjects vaccinated with vaccines designed against the original SARS-CoV-2 strain using SEQ ID NO:1 or induced in subjects after infection with the original SARS-CoV-2 strain comprising SEQ ID NO:1. A mutation/substitution in K417 occurs near the top of the coronavirus spike, where it may alter the shape of the protein, which may help to evade some types of coronavirus antibodies. Such SARS-CoV-2 are called SARS-CoV-2 K417 variants throughout the present invention and include e.g. SARS-CoV-2 B.1.351 (South Africa), SARS-CoV-2 B.1.1.7 (UK), P.1 (Brazil), AY.1/AY.2 or B.1.1.529 (Omicron, South Africa) (including BA.1_v1, BA.1_v0, B.1.1.529, BA.2, BA.1_v2, BA.1_v3, BA.1_v4, BA.1_v5).

Accordingly it may be advantageous that the RNA of the invention provides a SARS-CoV-2 spike protein comprising a substitution in position K417 to allow the induction of efficient immune responses against virus SARS-CoV-2 K417 variants.

In preferred embodiments, the SARS-CoV-2 spike protein comprises an amino acid substitution at position K417, wherein the amino acids N501 is substituted with S, T, Q or N (amino acid positions according to reference SEQ ID NO: 1). Accordingly, the antigenic peptide or protein selected from or derived from SARS-CoV-2 spike protein comprises a K417S, K417T, K417Q or K417N amino acid substitution.

In particularly preferred embodiments, the SARS-CoV-2 spike protein comprises an amino acid substitution at position N501, wherein the amino acids K417 is substituted with T or N (amino acid positions according to reference SEQ ID NO: 1). Accordingly, the antigenic peptide or protein selected from or derived from SARS-CoV-2 spike protein comprises a K417T or K417N amino acid substitution. In certain preferred embodiments the antigenic peptide or protein selected from or derived from SARS-CoV-2 spike protein comprises a K417N amino acid substitution.

In preferred embodiments, the SARS-CoV-2 spike protein comprises an amino acid substitution at position L452, wherein the amino acids L452 is substituted with a different amino acid (amino acid positions according to reference SEQ ID NO: 1).

Without wishing to be bound to theory, an amino acid substitution at position L452 may help SARS-CoV-2 virus variants to evade antibody detection of some types of antibodies induced in subjects vaccinated with vaccines designed against the original SARS-CoV-2 strain based on SEQ ID NO:1 or induced in subjects after infection with the original SARS-CoV-2 strain having SEQ ID NO:1. A mutation/substitution in L452 occurs near the top of the coronavirus spike, where it may alter the shape of the protein, which may help to evade some types of coronavirus antibodies. Such SARS-CoV-2 are called SARS-CoV-2 L452 variants throughout the present invention and include e.g. SARS-CoV-2 B.1.617.1 (India), SARS-CoV-2 B.1.617.2 (India), or SARS-CoV-2 B.1.617.3 (India).

Accordingly it may be advantageous that the RNA of the invention provides a SARS-CoV-2 spike protein comprising a substitution in position L452 to allow the induction of efficient immune responses against virus SARS-CoV-2 L452 variants.

In preferred embodiments, the SARS-CoV-2 spike protein comprises an amino acid substitution at position L452, wherein the amino acids L452 is substituted with R or Q (amino acid positions according to reference SEQ ID NO: 1). Accordingly, the antigenic peptide or protein selected from or derived from SARS-CoV-2 spike protein comprises an L452R or L452Q amino acid substitution.

In particularly preferred embodiments, the SARS-CoV-2 spike protein comprises an amino acid substitution at position L452, wherein the amino acids L452 is substituted with R (amino acid positions according to reference SEQ ID NO: 1). Accordingly, the antigenic peptide or protein selected from or derived from SARS-CoV-2 spike protein comprises a L452R amino acid substitution.

In preferred embodiments, the SARS-CoV-2 spike protein comprises an amino acid substitution at a position located in the furin cleavage site (amino acid position aa 681 to 685; amino acid positions according to reference SEQ ID NO: 1). That sequence stretch (PRRAR in SEQ ID NO: 1) is believed to serve as a recognition site for furin cleavage.

Without wishing to be bound to theory, amino acid substitutions or mutations in the furin cleavage site may help new emerging SARS-CoV-2 variants to have increased membrane fusion and thus cause increased transmissibility.

In preferred embodiments, the SARS-CoV-2 spike protein comprises an amino acid substitution at position P681 in the furin cleavage site. Suitably, the amino acids P681 is substituted with a different amino acid (amino acid positions according to reference SEQ ID NO: 1), preferably an amino acid that improves furin cleavage. Such SARS-CoV-2 are called SARS-CoV-2 P681 variants throughout the present invention and include e.g. SARS-CoV-2 B.1.617.1 (India), SARS-CoV-2 B.1.617.2 (India), or SARS-CoV-2 B.1.617.3 (India), SARS-CoV-2 B.1.1.7 (UK), SARS-CoV-2 A.23.1 (Uganda), or B.1.1.529 (Omicron, South Africa) (including BA.1_v1, BA.1_v0, B.1.1.529, BA.2, BA.1_v2, BA.1_v3, BA.1_v4, BA.1_v5).

Accordingly it may be advantageous that the RNA of the invention provides a SARS-CoV-2 spike protein comprising a substitution in position P681 to allow the induction of efficient immune responses against virus SARS-CoV-2 P681 variants.

In preferred embodiments, the SARS-CoV-2 spike protein comprises an amino acid substitution at position P681, wherein the amino acids P681 is substituted with R or H (amino acid positions according to reference SEQ ID NO: 1). Accordingly, the antigenic peptide or protein selected from or derived from SARS-CoV-2 spike protein comprises an P681R or P681H amino acid substitution.

In particularly preferred embodiments, the SARS-CoV-2 spike protein comprises an amino acid substitution at position P681, wherein the amino acids P681 is substituted with R (amino acid positions according to reference SEQ ID NO: 1). Accordingly, the antigenic peptide or protein selected from or derived from SARS-CoV-2 spike protein comprises a P681R amino acid substitution.

In particularly preferred embodiments, the SARS-CoV-2 spike protein that is encoded by the RNA of the invention comprises an amino acid substitution at position L452 as defined herein, preferably L452R, and an amino acid substitution at position P681 as defined herein, preferably P681R (amino acid positions according to reference SEQ ID NO: 1).

In another particularly preferred embodiment, the SARS-CoV-2 spike protein that is encoded by the RNA of the invention comprises an amino acid substitution at position L452 as defined herein, preferably L452R, and an amino acid substitution at position P681 as defined herein, preferably P681R (amino acid positions according to reference SEQ ID NO: 1). In further preferred embodiment, the SARS-CoV-2 spike protein that is encoded by the RNA of the invention comprises an amino acid substitution at position L452 as defined herein, preferably L452R, an amino acid substitution at position P681 as defined herein, preferably P681R and at position D614 as defined herein, preferably D614G, (amino acid positions according to reference SEQ ID NO: 1).

In particularly preferred embodiments, the SARS-CoV-2 spike protein that is encoded by the RNA of the invention comprises an amino acid substitution at position N501 as defined herein, preferably N501Y, and an amino acid substitution at position E484 as defined herein, preferably E484K (amino acid positions according to reference SEQ ID NO: 1).

In particularly preferred embodiments, the SARS-CoV-2 spike protein that is encoded by the RNA of the invention comprises an amino acid substitution at position L452 as defined herein, preferably L452R, and an amino acid substitution at position E484 as defined herein, preferably E484Q (amino acid positions according to reference SEQ ID NO: 1).

In preferred embodiments, the SARS-CoV-2 spike protein comprises, in addition to the substitutions defined above (at positions E484, N501, L452 and optionally P681), at least one, in particular 1, 2, 3, 4, 5, 6, 7, 8, 9, or 10 additional amino acid substitution, insertion or deletion selected from List 1A or List 1 B.

In particularly preferred embodiments, the SARS-CoV-2 spike protein that is encoded by the RNA of the invention comprises an amino acid substitution or deletion at position H69 as defined herein, preferably H69del, and an amino acid substitution or deletion at position V70 as defined herein, preferably V70del (amino acid positions according to reference SEQ ID NO: 1). In further preferred embodiment, the SARS-CoV-2 spike protein that is encoded by the RNA of the invention comprises a deletion at both H69 and V70.

In preferred embodiments, the SARS-CoV-2 spike protein that is encoded by the RNA of the invention comprises at least one further amino acid substitution or deletion selected from the following SARS-CoV-2 isolates: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

In preferred embodiments, the SARS-CoV-2 spike protein that is encoded by the RNA of the invention comprises amino acid substitutions or deletions selected from (relative to SEQ ID NO: 1):

K986P, V987P, A67V, H69del, V70del, T95I, G142D, V143del, Y144del, Y145del, N211del, L2121, ins214EPE, G339D, 5371 L, S373P, S375F, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v1);

K986P, V987P, A67V, H69del, V70del, T95I, G142D, V143del, Y144del, Y145del, N211del, L2121, ins214EPE, G339D, 5371 L, S373P, S375F, K417N, N440K, G446S, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v0);

K986P, V987P, A67V, T95I, G339D, 5371 L, S373P, S375F, S477N, T478K, E484A, Q493R, G496S, Q498R, N501Y, Y505H, T547K, D614G, H655Y, N679K, P681H, D796Y, N856K, Q954H, N969K, L981F (SA, B.1.1.529);

K986P, V987P, T191, L24del, P25del, P26del, A27S, G142D, V213G, G339D, S371F, S373P, S375F, T376A, D405N, S477N, T478K, E484A, Q493R, Q498R, N501Y, Y505H, D614G, H655Y, N679K, P681H, D796Y, Q954H, N969K (SA, BA.2);

K986P, V987P, A67V, H69del, V70del, T95I, G142D, V143del, Y144del, Y145del, N211del, L2121, ins214EPE, G339D, S371L, S373P, S375F, N440K, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v2);

K986P, V987P, A67V, H69del, V70del, T95I, G142D, V143del, Y144del, Y145del, N211del, L2121, ins214EPE, G339D, S371L, S373P, S375F, S477N, T478K, E484A, Q493R, G496S, Q498R, N501Y, Y505H, T547K, D614G, H655Y, N679K, P681H, D796Y, N856K, Q954H, N969K, L981F (SA, BA.1_v3);

K986P, V987P, A67V, H69del, V70del, T95I, G142D, V143del, Y144del, Y145del, N211del, L2121, ins214EPE, G339D, S371L, S373P, S375F, S477N, T478K, E484A, Q493R, G496S, Q498R, N501Y, Y505H, T547K, D614G, H655Y, N679K, P681H, A701V, N764K, D796Y, N856K, Q954H, N969K, L981F (SA, BA.1_v4);

K986P, V987P, A67V, H69del, V70del, T951, G142D, V143del, Y144del, Y145del, N211del, L2121, ins214EPE, G339D, S371L, S373P, S375F, G446S, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v5);

E484K, N501Y, L18F, D80A, D215G, L242del, A243del, L244del, R246I, K417N, D614G, and A701V; (SA; B.1.351)

E484K, N501Y, L18F, D80A, D215G, L242del, A243del, L244del, K417N, D614G, and A701V; (SA; B.1.351)

E484K, N501Y, L18F, T20N, P26S, D138Y, R190S, K417T, D614G, H655Y, and T1027I; (Brazil; P1)

E484K, N501Y, L18F, T20N, P26S, D138Y, R190S, K417T, D614G, H655Y, T1027I, and V1176F; (Brazil P1)

L452R, P681R, and D614G; (B.1.617.1; India)

L452R, E484Q, P681R, E154K, D614G, and Q1071H; (B.1.617.2; India)

L452R, P681R, T19R, F157del, R158del, T478K, D614G, and D950N; (B.1.617.2; India)

T19R, L452R, E484Q, D614G, P681R and D950N; (B.1.617.3; India)

G75V, T761, S247del, Y248del, L249del, T250del, P251del, G252del, D253del, L4520, F490S, D614G, and T859N; (C.37.1; Peru)

T95I, Y145N, R346K, E484K, N501Y, D614G, P681H, and D950N; (B.1.1.621)

T95I, Y144T, Y145S, ins145N, R346K, E484K, N501Y, D614G, P681H, and D950N; (B.1.1.621)

H69del, V70del, Y144del, E484K, N501Y, A570D, D614G, P681H, T716I, S982A, and D1118H; (B.1.1.7-E484K)

S13I, W152C, L452R, and D614G; (B.1.429)

L452R; and D614G; (B.1.429)

H69del; V70del; N439K; D614G; (B.1.258)

T951; E484K; D614G; and A701V; (B.1.526)

L5F, T951, D253G, E484K, D614G, and A701V; (B.1.526)

L5F, T951, D253G, S477N, D614G, and Q957R; (B.1.526)

F157L; V367F; Q613H; and P681R (A.23.1)

S254F; D614G; P681R; and G769V (A.23.1)

T478K; D614G; P681H; and T732A (B.1.1.519; Mexico)

P26S, H69del, V70del, V126A, Y144del, L242del, A243del, L244del, H245Y, S477N, E484K, D614G, P681H, T1027I and D1118H; (B.1.620; Africa)

ins214TDR, Q414K, N450K, D614G, and T716I; (B.1.214.2)

S12F, H69del, V70del, W152R, R346S, L452R, D614G, Q677H and A899S; (C.36.3; Thailand)

E484K, D614G and V1176F; (P2)

Q52R; A67V; H69del; V70del; F157del; R158del; E484K; D614G; Q677H and F888L; (B.1.525)

Q52R; A67V; H69del; V70del; Y144del; E484K; D614G; Q677H and F888L; (B.1.525)

A67V; H69del; V70del; Y144del; E484K; D614G; Q677H and F888L; (B.1.525)

T19R; T951; G142D, E156G, F157del; R158del; W258L; K417N; L452R; T478K; K558N, D614G; P681R; and D950N; (AY.1)

T19R; V70F; G142D, E156G, F157del; R158del; A222V, K417N; L452R; T478K; D614G; P681R; and D950N; (AY.2)

T19R; T951; F157del; R158del; W258L; K417N; L452R; T478K; D614G; P681R; and D950N; or (AY.1)

T19R; V70F; F157del; R158del; A222V; K417N; L452R; T478K; D614G; P681R; and D950N; (AY.2)

H69del, V70del and D614G;

D614G and M12291;

A222V and D614G;

S477N and D614G;

N439K and D614G;

H69del, V70del, Y453F, D614G and 16921;
Y453F and D614G;
D614G and I692V;
H69del, V70del, A222V, Y453F, D614G and 16921;
N501Y and D614G;
K417N; E484K; N501Y and D614G; or
E484K and D614G.

In particularly preferred embodiments, the SARS-CoV-2 spike protein that is encoded by the RNA of the invention comprises the following amino acid substitutions or deletions (relative to SEQ ID NO: 1):

E484K, N501Y, L18F, D80A, D215G, L242del, A243del, L244del, R246I, K417N, D614G, and A701V;
E484K, N501Y, L18F, D80A, D215G, L242del, A243del, L244del, K417N, D614G, and A701V;
E484K, N501Y, L18F, T20N, P26S, D138Y, R190S, K417T, D614G, H655Y, and T1027I;
E484K, N501Y, L18F, T20N, P26S, D138Y, R190S, K417T, D614G, H655Y, T1027I, and V1176F;
L452R, P681R, and D614G;
L452R, E484Q, P681R, E154K, D614G, and Q1071H; or
L452R, P681R, T19R, F157del, R158del, T478K, D614G, and D950N.

In even more preferred embodiments, the SARS-CoV-2 spike protein that is encoded by the RNA of the invention comprises the following amino acid substitutions or deletions (relative to SEQ ID NO: 1):

E484K, N501Y, L18F, D80A, D215G, L242del, A243del, L244del, R246I, K417N, D614G, and A701V; or
E484K, N501Y, L18F, D80A, D215G, L242del, A243del, L244del, K417N, D614G, and A701V.

In further particularly preferred embodiments, the SARS-CoV-2 spike protein that is encoded by the RNA of the invention comprises the following amino acid substitutions or deletions (relative to SEQ ID NO: 1):

L452R, P681R, and D614G;
L452R, E484Q, P681R, E154K, D614G, and Q1071H;
L452R, P681R, T19R, F157del, R158del, T478K, D614G, and D950N; or
T19R, L452R, E484Q, D614G, P681R and D950N.

In even more preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1, 10, 22738, 22740, 22742, 22744, 22746, 22748, 22750, 22752, 22754, 22756, 22758, 22959-22964, 27087-27109, 28540-28588, 28917-28920, or an immunogenic fragment or immunogenic variant of any of these. Thus, in some embodiments, the SARS-CoV-2 spike protein is at least 95%, identical to any one of SEQ ID NOs: 1, 10, 22738, 22740, 22742, 22744, 22746, 22748, 22750, 22752, 22754, 22756, 22758, 22959-22964, 27087-27109, 28540-28588, or 28917-28920. In certain embodiments, the SARS-CoV-2 spike protein is identical to any one of SEQ ID NOs: 22738, 22740, 22742, 22744, 22746, 22748, 22750, 22752, 22754, 22756, 22758, 22959-22964, 27087-27109, 28540-28588, or 28917-28920. Further information regarding said amino acid sequences is also provided in Table 1, and under <223> identifier of the ST25 sequence listing of respective sequence SEQ ID NOs.

In some embodiments, a fragment of a spike protein (S) as defined herein may be encoded by the RNA of the invention, wherein said fragment may be N-terminally truncated, lacking the N-terminal amino acids 1 to up to 100 of the full length SARS-CoV-2 variant protein and/or wherein said fragment may be C-terminally truncated, lacking the C-terminal amino acids (aa) 531 to up to aa 1273 of the full length SARS-CoV-2 variant protein. Such "fragment of a spike protein (S)" may additionally comprise amino acid substitutions (as described herein) and may additionally comprise at least one heterologous peptide or protein element (as described herein). In preferred embodiments, a fragment of a spike protein (S) may be C-terminally truncated, thereby lacking the C-terminal transmembrane domain (that is, lacking aa 1212 to aa 1273 or lacking aa 1148 to aa 1273) (amino acid positions according to reference SEQ ID NO: 1).

In other embodiments, the encoded spike protein (S) derived from SARS-CoV-2 lacks the transmembrane domain (TM) (amino acid position aa 1212 to aa 1273 according to reference SEQ ID NO: 1). In embodiments, the encoded spike protein (S) derived from SARS-CoV-2 lacks an extended part of the transmembrane domain (TMflex) (amino acid position aa 1148 to aa 1273 according to reference SEQ ID NO: 1). Without wishing to being bound to theory, a spike protein (S) lacking the transmembrane domain (TM or TMflex) as defined herein could be suitable for a vaccine, as such a protein would be soluble and not anchored in the cell membrane. A soluble protein may therefore be produced (that is translated) in higher concentrations upon administration to a subject, leading to improved immune responses.

Without wishing to being bound to theory, RBD (aa 319 to aa 541) and CND (aa 329 to aa 529) domains, as referenced for amino acid positions with SEQ ID NO:1, may be crucial for immunogenicity. Both regions are located at the 51 fragment of the spike protein. Accordingly, it may be suitable in the context of the invention that the antigenic peptide or protein comprises or consists of an 51 fragment of the spike protein or an immunogenic fragment or immunogenic variant thereof. Suitably, such an 51 fragment may comprise at least an RBD and/or a CND domain as defined above. In certain embodiments the SARS-CoV-2 spike protein CND domain that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27051-27086 or an immunogenic fragment or immunogenic variant of any of these. Thus, in some embodiments, the SARS-CoV-2 spike protein CND domain is at least 95%, identical to any one of SEQ ID NOs: 27051-27086. In certain embodiments, the SARS-CoV-2 spike protein CND domain is identical to any one of SEQ ID NOs: 27051-27086. Further information regarding said amino acid sequences is also provided in Table 1, and under <223> identifier of the ST25 sequence listing of respective sequence SEQ ID NOs.

In preferred embodiments, the encoded at least one antigenic peptide or protein comprises or consists of a receptor-binding domain (RBD; aa 319 to aa 541), wherein the RBD comprises or consists of a spike protein fragment, or an immunogenic fragment or immunogenic variant thereof. In certain embodiments the SARS-CoV-2 spike protein RBD domain that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27007-27046 or an immunogenic fragment or immunogenic variant of any of these. Thus, in some embodiments, the SARS-CoV-2 spike protein RBD domain is at least 95%, identical to any one of SEQ ID NOs: 27007-27046. In certain embodiments, the SARS-CoV-2 spike protein RBD domain is identical to any one of SEQ ID NOs: 27007-27046. Further information regarding said amino acid sequences is also provided in Table 1, and under <223> identifier of the ST25 sequence listing of respective sequence SEQ ID NOs.

In further preferred embodiments, the encoded at least one antigenic peptide or protein comprises or consists of a truncated receptor-binding domain (truncRBD; aa 334 to aa 528), wherein the RBD comprises or consists of a spike protein fragment, or an immunogenic fragment or immunogenic variant thereof.

Such "fragment of a spike protein (S)" (RBD; aa 319 to aa 541 or truncRBD, aa 334 to aa 528), may additionally comprise amino acid substitutions (as described herein) and may additionally comprise at least one heterologous peptide or protein element (as described herein).

In particularly preferred embodiments, the encoded at least one antigenic peptide or protein comprises or consists of a spike protein (S), wherein the spike protein (S) comprises or consists of a spike protein fragment 51, or an immunogenic fragment or immunogenic variant thereof.

In preferred embodiments, the encoded at least one antigenic peptide or protein comprises a spike protein fragment 51, and lacks at least 70%, 80%, 81%, 82%, 83%,84%, 85%, 86%, 87%, 88%, 89%, 90%, 91%, 92%, 93%, 94%, 95%, 96%, 97%, 98%, 99% or 100% of spike protein fragment S2 (aa 682 to aa 1273). Such embodiments may be beneficial, as the S1 fragment comprises neutralizing epitopes.

Without wishing to being bound to theory, it may be suitable that the antigenic peptide or protein comprises or consists of spike protein fragment 51 and (at least a fragment of) spike protein fragment S2, because the formation of an immunogenic spike protein may be promoted.

Accordingly, in particularly preferred embodiments, the encoded at least one antigenic peptide or protein comprises or consists of a spike protein (S), wherein the spike protein (S) comprises or consists of a spike protein fragment S1 or an immunogenic fragment or immunogenic variant thereof, and spike protein fragment S2 or an immunogenic fragment or immunogenic variant thereof.

In alternative preferred embodiments, the encoded at least one antigenic peptide or protein comprises or consists of a full-length spike protein or an immunogenic fragment or immunogenic variant of any of these.

The term "full length spike protein" has to be understood as a spike protein derived from a SARS-CoV-2 having an amino acid sequence corresponding to essentially the full spike protein. Accordingly, a "full length spike protein" may comprise aa 1 to aa 1273 (reference protein: SEQ ID NO: 1). Accordingly, a full length spike protein may typically comprise a secretory signal peptide, a spike protein fragment S1, a spike protein fragment S2, a receptor binding domain (RBD), and a critical neutralisation domain CND, and a transmembrane domain. Notably, also variants that comprise certain amino acid substitutions (e.g. for allowing pre-fusion stabilization of the S protein) or natural occurring amino acid deletions are encompassed by the term "full length spike protein".

In particularly preferred embodiments, the spike protein (S) that is encoded by the RNA of the first aspect is designed or adapted to stabilize the antigen in pre-fusion conformation. A pre-fusion conformation is particularly advantageous in the context of an efficient coronavirus vaccine, as several potential epitopes for neutralizing antibodies may merely be accessible in said pre-fusion protein conformation. Furthermore, remaining of the protein in the pre-fusion conformation is aimed to avoid immunopathological effects, like e.g. enhanced disease and/or antibody dependent enhancement (ADE).

In preferred embodiments, administration of the RNA (or a composition or vaccine) encoding pre-fusion stabilized spike protein to a subject elicits spike protein neutralizing antibodies and does not elicit disease-enhancing antibodies. In particular, administration of a nucleic acid (or a composition or vaccine) encoding pre-fusion stabilized spike protein to a subject does not elicit immunopathological effects, like e.g. enhanced disease and/or antibody dependent enhancement (ADE).

Accordingly, in preferred embodiments, the RNA of the invention comprises at least one coding sequence encoding at least one antigenic peptide or protein that is selected or is derived from a SARS-CoV-2 spike protein (S), wherein the SARS-CoV-2 spike protein (S) is a pre-fusion stabilized spike protein (S_stab). Suitably, said pre-fusion stabilized spike protein comprises at least one pre-fusion stabilizing mutation.

The term "pre-fusion conformation" as used herein relates to a structural conformation adopted by the ectodomain of the SARS-CoV-2 S protein following processing into a mature SARS-CoV-2 S protein in the secretory system, and prior to triggering of the fusogenic event that leads to transition of the SARS-CoV-2 S to the postfusion conformation.

A "pre-fusion stabilized spike protein (S_stab)" as described herein comprises one or more amino acid substitutions, deletions, or insertions compared to a native SARS-CoV-2 S sequence that provide for increased retention of the prefusion conformation compared to SARS-CoV-2 S ectodomain trimers formed from a corresponding native SARS-CoV-2 S sequence. The "stabilization" of the prefusion conformation by the one or more amino acid substitutions, deletions, or insertions can be, for example, energetic stabilization (for example, reducing the energy of the pre-fusion conformation relative to the post-fusion open conformation) and/or kinetic stabilization (for example, reducing the rate of transition from the prefusion conformation to the postfusion conformation). Additionally, stabilization of the SARS-CoV-2 S ectodomain trimer in the prefusion conformation can include an increase in resistance to denaturation compared to a corresponding native SARS-CoV-2 S sequence.

Accordingly, in preferred embodiments, the SARS-CoV-2 spike protein includes one or more amino acid substitutions that stabilize the S protein in the pre-fusion conformation, for example, substitutions that stabilize the membrane distal portion of the S protein (including the N-terminal region) in the pre-fusion conformation.

Stabilization of the SARS-CoV-2 coronavirus spike protein may be obtained by substituting at least one amino acid at position K986 and/or V987 with amino acids that stabilize the spike protein in a prefusion conformation (amino acid positions according to reference SEQ ID NO: 1).

In preferred embodiments, the pre-fusion stabilizing mutation comprises an amino acid substitution at position K986 and V987, wherein the amino acids K986 and/or V987 are substituted with an amino acid selected from A, I, L, M, F, V, G, or P (amino acid positions according to reference SEQ ID NO: 1).

Preferably, stabilization of the prefusion conformation is obtained by introducing two consecutive proline substitutions at residues K986 and V987 in the spike protein (amino acid positions according to reference SEQ ID NO: 1). Accordingly, in preferred embodiments, the pre-fusion stabilized spike protein (S_stab) comprises at least one pre-fusion stabilizing mutation, wherein the at least one pre-fusion stabilizing mutation comprises the following amino acid substitutions: K986P and V987P (amino acid positions according to reference SEQ ID NO: 1).

In particularly preferred embodiments, the SARS-CoV-2 spike protein that is encoded by the RNA of the invention is a pre-fusion stabilized spike protein (S_stab) comprising at least one pre-fusion stabilizing K986P and V987P mutation and additionally comprising the following amino acid substitutions or deletions (amino acid positions according to reference SEQ ID NO: 1):

E484K, N501Y, and optionally L18F, D80A, D215G, L242del, A243del, L244del, R246I, K417N, D614G, A701V;
E484K, N501Y, and optionally L18F, D80A, D215G, L242del, A243del, L244del, K417N, D614G, A701V;
N501Y, P681H, and optionally H69del, V70del, Y144del, A570D, D614G, T716I, S982A, D1118H;
N501Y, P681H, E484K, and optionally H69del, V70del, Y144del, A570D, D614G, T716I, S982A, D1118H;
E484K, N501Y, and optionally L18F, T20N, P26S, D138Y, R190S, K417T, D614G, H655Y, T1027I;
E484K, N501Y, and optionally L18F, T20N, P26S, D138Y, R190S, K417T, D614G, H655Y, T1027I, V1176F;
N501Y, P681H, E484K, and optionally H69del, V70del, Y144del, A570D, D614G, T716I, S982A, D1118H;
L452R, and optionally S13I, W152C, D614G;
L452R, D614D and optionally P681R;
L452R, D614D, P681R and optionally E484Q, E154K, Q1071H;
L452R, D614D, P681R and optionally T19R, L452R, D950N;
L452R, D614D, P681R and optionally T19R, F157del, T478K, D950N;
E484K, and optionally Q52R, A67V, H69del, V70del, delY144, D614G, Q677H, F888L;
E484K, and optionally A67V, H69del, V70del, Y144del, D614G, Q677H, F888L;
E484K, and optionally L5F, T951, D253G, D614G, A701V;
P681R, and optionally F157L, V367F, Q613H;
P681R, and optionally S254F, D614G, G769V;
L452R, P681R, and optionally D614G;
L452R, E484Q, P681R, and optionally E154K, D614G, Q1071H;
L452R, P681R, and optionally T19R, F157del, R158del, T478K, D614G, D950N;
E484K, and optionally D614G, V1176F;
L452Q, and optionally G75V, T761, R246del, S247del, Y248del, L249del, T250del, P251del, G252del, F490S, D614G, T859N;
K417N, and optionally P681R;
K417N, P681R, and optionally D614G;
K417N, L452R, P681R, and optionally D614G;
K417N, T478K, P681R, and optionally D614G;
K417N, D950N, P681R, and optionally D614G.
K417N, D614G, P681R, and optionally T478K;
K417N, D614G, P681R, and optionally L452R;
K417N, D614G, P681R, L452R and optionally T478K;
S247del, Y248del, L249del, T250del, P251del, G252del, D253del and optionally D614G;
S247del, Y248del, L249del, T250del, P251del, G252del, D253del and optionally L4520, D614G;
H69del, V70del and optionally D614G;
H69del, V70del, E484K and optionally D614G;
H69del, V70del, N501Y and optionally D614G; or
H69del, V70del, N501Y, E484K and optionally P681H.

In particularly preferred embodiments, the SARS-CoV-2 spike protein that is encoded by the RNA of the invention is a pre-fusion stabilized spike protein (S_stab) (or a fragment or variant thereof) comprising at least one pre-fusion stabilizing K986P and V987P mutation and additionally comprises the following amino acid substitutions or deletions (amino acid positions according to reference SEQ ID NO: 1):

E484K, N501Y, L18F, D80A, D215G, L242del, A243del, L244del, R246I, K417N, D614G, and A701V;
E484K, N501Y, L18F, D80A, D215G, L242del, A243del, L244del, K417N, D614G, and A701V;
E484K, N501Y, L18F, T20N, P26S, D138Y, R190S, K417T, D614G, H655Y, and T1027I;
E484K, N501Y, L18F, T20N, P26S, D138Y, R190S, K417T, D614G, H655Y, T1027I, V1176F;
L452R, P681R, and D614G;
L452R, E484Q, P681R, E154K, D614G, and Q1071H; or
L452R, P681R, T19R, F157del, R158del, T478K, D614G, and D950N.

In particularly preferred embodiments, the SARS-CoV-2 spike protein that is encoded by the RNA of the invention is a pre-fusion stabilized spike protein (S_stab) (or a fragment or variant thereof) comprising amino acid substitutions or deletions selected from (amino acid positions according to reference SEQ ID NO: 1):

K986P, V987P, E484K, N501Y, L18F, D80A, D215G, L242del, A243del, L244del, R246I, K417N, D614G, and A701V; or
K986P, V987P, E484K, N501Y, L18F, D80A, D215G, L242del, A243del, L244del, K417N, D614G, and A701V.

It has to be emphasized that in the context embodiments of the invention any SARS-CoV-2 coronavirus spike protein as defined herein may be mutated as described above (exemplified for reference protein SEQ ID NO: 1) to stabilize the spike protein in the pre-fusion conformation.

According to various embodiments, the RNA of the invention encodes at least one antigenic SARS-CoV-2 spike protein as defined herein and, additionally, at least one heterologous peptide or protein element.

Suitably, the at least one heterologous peptide or protein element may promote or improve secretion of the encoded antigenic SARS-CoV-2 spike protein (e.g. via secretory signal sequences), promote or improve anchoring of the encoded antigenic SARS-CoV-2 spike protein in the plasma membrane (e.g. via transmembrane elements), promote or improve formation of antigen complexes (e.g. via multimerization domains or antigen clustering elements), or promote or improve virus-like particle formation (VLP forming sequence). In addition, the RNA of the first aspect may additionally encode peptide linker elements, self-cleaving peptides, immunologic adjuvant sequences or dendritic cell targeting sequences.

Suitable multimerization domains may be selected from the list of amino acid sequences according to SEQ ID NOs: 1116-1167 of WO2017/081082, or fragments or variants of these sequences. Suitable transmembrane elements may be selected from the list of amino acid sequences according to SEQ ID NOs: 1228-1343 of WO2017/081082, or fragments or variants of these sequences. Suitable VLP forming sequences may be selected from the list of amino acid sequences according to SEQ ID NOs: 1168-1227 of the patent application WO2017/081082, or fragments or variants of these sequences. Suitable peptide linkers may be selected from the list of amino acid sequences according to SEQ ID NOs: 1509-1565 of the patent application WO2017/081082, or fragments or variants of these sequences. Suitable self-cleaving peptides may be selected from the list of amino acid sequences according to SEQ ID NOs: 1434-1508 of the patent application WO2017/081082, or fragments or variants of these sequences. Suitable immunologic adjuvant sequences may be selected from the list of amino acid sequences according to SEQ ID NOs: 1360-1421 of the patent application WO2017/081082, or fragments or variants of these sequences. Suitable dendritic cell (DCs) targeting sequences may be selected from the list of amino acid sequences according to SEQ ID NOs: 1344-1359 of the patent application WO2017/081082, or fragments or variants of these sequences. Suitable secretory signal peptides may be selected from the list of amino acid sequences according to SEQ ID NOs: 1-1115 and SEQ ID NO: 1728 of published PCT patent application WO2017/081082, or fragments or variants of these sequences.

In preferred embodiments, the RNA encoding at least one antigenic SARS-CoV-2 spike protein additionally encodes at least one heterologous secretory signal sequences and/or trimerization element, and/or antigen clustering element, and/or VLP forming sequence.

Accordingly, in preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22738, 22740, 22742, 22744, 22746, 22748, 22750, 22752, 22754, 22756, 22758, 22959-22964, 27087-27109, 28540-28588, 28917-28920 or an immunogenic fragment or immunogenic variant of any of these. Thus in some embodiments, the SARS-CoV-2 spike protein is at least 95%, identical to any one of SEQ ID NOs: 22738, 22740, 22742, 22744, 22746, 22748, 22750, 22752, 22754, 22756, 22758, 22959-22964, 27087-27109, 28540-28588, or 28917-28920. In certain embodiments, the SARS-CoV-2 spike protein is identical to any one of SEQ ID NOs: 22738, 22740, 22742, 22744, 22746, 22748, 22750, 22752, 22754, 22756, 22758, 22959-22964, 27087-27109, 28540-28588, or 28917-28920. Further information regarding said amino acid sequences is also provided in Table 1, and under <223> identifier of the ST25 sequence listing of respective sequence SEQ ID NOs.

Accordingly, in preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27093-27095, 28552-28558 or an immunogenic fragment or immunogenic variant of any of these. Thus in some embodiments, the SARS-CoV-2 spike protein is at least 95%, identical to any one of SEQ ID NOs: 27093-27095, 28552-28558. In certain embodiments, the SARS-CoV-2 spike protein is identical to any one of SEQ ID NOs: 27093-27095, 28552-28558.

In further preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095, 28552-28557 or an immunogenic fragment or immunogenic variant of any of these. Thus in some embodiments, the SARS-CoV-2 spike protein is at least 95%, identical to any one of SEQ ID NOs: 27095, 28552-28557. In certain embodiments, the SARS-CoV-2 spike protein is identical to any one of SEQ ID NOs: 27095, 28552-28557.

In further preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095 or an immunogenic fragment or immunogenic variant of any of these. Thus in some embodiments, the SARS-CoV-2 spike protein is at least 95%, identical to any one of SEQ ID NOs: 27095. In certain embodiments, the SARS-CoV-2 spike protein is identical to any one of SEQ ID NOs: 27095.

In further preferred embodiments, the SARS-CoV-2 spike protein that is encoded by the RNA of the invention comprises or consists of at least one of the amino acid sequences or amino acid coding sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23090, 23091, 22960, 22961, 28540 or an immunogenic fragment or immunogenic variant of any of these. Thus in some embodiments, the SARS-CoV-2 spike protein is at least 95%, identical to any one of SEQ ID NOs: 23090, 23091, 22960, 22961, 28540. In certain embodiments, the SARS-CoV-2 spike protein is identical to any one of SEQ ID NOs: 23090, 23091, 22960, 22961, 28540.

In still further preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545 or an immunogenic fragment or immunogenic variant of any of these. Thus in some embodiments, the SARS-CoV-2 spike protein is at least 95%, identical to any one of SEQ ID NOs: 27096, 28545. In certain embodiments, the SARS-CoV-2 spike protein is identical to any one of SEQ ID NOs: 27096, 28545.

In still a further preferred embodiment, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959 or an immunogenic fragment or immunogenic variant of any of these. Thus in some embodiments, the SARS-CoV-2 spike protein is at least 95%, identical to any one of SEQ ID NOs: 22959. In certain embodiments, the SARS-CoV-2 spike protein is identical to any one of SEQ ID NOs: 22959.

In a further preferred embodiment, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920 or an immunogenic fragment or immunogenic variant of any of these. Thus in some embodiments, the SARS-CoV-2 spike protein is at least 95%, identical to any one of SEQ ID NOs: 28541-28544, 28917-28920. In certain embodiments, the SARS-CoV-2 spike protein is identical to any one of SEQ ID NOs: 28541-28544, 28917-28920.

Preferred antigenic peptide or proteins derived from an SARS-CoV-2 as defined herein are provided in Table 1. Therein, each row corresponds to a suitable SARS-CoV-2 spike protein construct. Column A of Table 1 provides a short description of the suitable antigen constructs. Column B of Table 1 provides protein (amino acid) SEQ ID NOs of respective antigen constructs. Column C Table 1 provides SEQ ID NO of the corresponding G/C optimized nucleic acid coding sequences (opt1, gc). Column D of Table 1 provides SEQ ID NO of the corresponding G/C content modified nucleic acid coding sequences (opt10, gc mod) (for a detailed description of "coding sequences", see paragraph "suitable coding sequences").

Notably, the description of the invention explicitly includes the information provided under <223> identifier of the ST25 sequence listing of the present application. Preferred RNA constructs comprising coding sequences of Table 1, e.g. mRNA sequences comprising the coding sequences of Table 1, are provided in Table 2.

TABLE 1

Preferred SARS-CoV-2 constructs (amino acid sequences and nucleic acid coding sequences):

| row | A | B | C | D |
|---|---|---|---|---|
| 1 | Full-length spike protein; S - WT | 1 | 136 | |
| 2 | Stabilized spike proteins; S_stab_PP; the RNA sequence encoding S-stab_PP but with wt codon usage is provided by SEQ ID NO: 28916 | 10, 22738, 22740, 22742, 22744, 22746, 22748, 22750, 22752, 22754, 22756, 22758, 22959-22964, 27087-27109, 28540-28588 | 137, 22765, 22767, 22769, 22771, 22773, 22775, 22777, 22779, 22781, 22783, 22785, 23089-23148, 27110-27201, 28589-28637 | 146, 23150-23184, 27202-27247 |
| 3 | Spike protein receptor binding domain; RBD | 13243, 22917, 22923, 27007-27046 | | |
| 4 | Spike protein critical neutralisation domain; CND | 13310, 27047-27086 | | |
| 5 | A222V_D614G S_stab_PP(K986P_V987P_A222V_D614G) | 22740 | 22767 | 23151 |
| 6 | N439K_D614G S_stab_PP(K986P_V987P_N439K_D614G) | 22742 | 22769 | 23152 |
| 7 | S477N_D614G S_stab_PP(K986P_V987P_S477N_D614G) | 22744 | 22771 | 23153 |
| 8 | N501Y_D614G S_stab_PP(K986P_V987P_N501Y_D614G) | 22746 | 22773 | 23154 |
| 9 | H69del_V70del_D614G S_stab_PP(K986P_V987P_H69del_V70del_D614G) | 22748 | 22775 | 23155 |
| 10 | Y453F_D614G S_stab_PP(K986P_V987P_Y453F_D614G) | 22750 | 22777 | 23156 |
| 11 | I692V_D614G S_stab_PP(K986P_V987P_D614G_I692V) | 22752 | 22779 | 23157 |
| 12 | M1229I_D614G S_stab_PP(K986P_V987P_D614G_M1229I) | 22754 | 22781 | 23158 |
| 13 | MINK1 (w/oM1229I) S_stab_PP(K986P_V987P_H69del_V70del_A222V_Y453F_S477N_D614G_I692V) | 22756 | 22783 | 23159 |
| 14 | MINK2 S_stab_PP(K986P_V987P_H69del_V70del_Y453F_D614G_I692V_M1229I) | 22758 | 22785 | 23160 |
| 15 | B.1.1.7 (UK) S_stab_PP(K986P_V987P_H69del_V70del_Y144del_N501Y_A570D_D614G_P681H_T716I_S982A_D1118H) | 22959 | 23089 | 23161 |
| 16 | minSA (B.1.351) S_stab_PP(K986P_V987P_K417N_E484K_N501Y_D614G) | 22960 | 23090 | 23162 |
| 17 | fullSA (B.1.351) S_stab_PP(K986P_V987P_L18F_D80A_D215G_L242del_A243del_L244del_R246I_K417N_E484K_N501Y_D614G_A701V) | 22961 | 23091 | 23163 |
| 18 | E484K S_stab_PP(K986P_V987P_E484K_D614G) | 22962 | 23092 | 23164 |
| 19 | P.1 (Brazil) S_stab_PP(K986P_V987P_L18F_T20N_P26S_D138Y_R190S_K417T_E484K_N501Y_D614G_H655Y_T1027I) | 22963 | 23093 | 23165 |
| 20 | B.1.429 (California) S_stab_PP(K986P_V987P_S13I_W152C_L452R_D614G) | 22964 | 23094 | 23166 |
| 21 | B.1.1.7 + E484K S_stab_PP(K986P_V987P_H69del_V70del_Y144del_E484K_N501Y_A570D_D614G_P681H_T716I_S982A_D1118H) | 27087 | 27110 | 27202 |

TABLE 1-continued

Preferred SARS-CoV-2 constructs (amino acid sequences and nucleic acid coding sequences):

| row | A | B | C | D |
|---|---|---|---|---|
| 22 | fullSAminusI246R S_stab_PP(K986P_V987P_L18F_D80A_D215G_L242del_A243del_L244del_K417N_E484K_N501Y_D614G_A701V) | 27088 | 27111 | 27203 |
| 23 | B.1.525 (Nigeria) S_stab_PP(K986P_V987P_Q52R_A67V_H69del_V70del_Y144del_E484K_D614G_Q677H_F888L) | 27089 | 27112 | 27204 |
| 24 | B.1.525_v2 (Nigeria) S_stab_PP(K986P_V987P_A67V_H69del_V70del_Y144del_E484K_D614G_Q677H_F888L) | 27090 | 27113 | 27205 |
| 25 | P.1 + V1176F (Brazil) S_stab_PP(K986P_V987P_L18F_T20N_P26S_D138Y_R190S_K417T_E484K_N501Y_D614G_H655Y_T1027I_V1176F) | 27091 | 27114 | 27206 |
| 26 | P.2 (Brazil) S_stab_PP(K986P_V987P_E484K_D614G_V1176F) | 27092 | 27115 | 27207 |
| 27 | B.1.617 (India) S_stab_PP(K986P_V987P_L452R_D614G_P681R) | 27093 | 27116 | 27208 |
| 28 | B.1.617.1 (India) S_stab_PP(K986P_V987P_E154K_L452R_E484Q_D614G_P681R_Q1071H) | 27094 | 27117 | 27209 |
| 29 | B.1.617.2 (India) S_stab_PP(K986P_V987P_T19R_F157del_R158del_L452R_T478K_D614G_P681R_D950N) | 27095 | 27118 | 27210 |
| 30 | C.37.1 (Peru) S_stab_PP(K986P_V987P_G75V_T76I_R246del_S247del_Y248del_L249del_T250del_P251del_G252del_L452Q_F490S_D614G_T859N) | 27096 | 27119 | 27211 |
| 31 | B.1.258 (CzechRepublic) S_stab_PP(K986P_V987P_H69del_V70del_N439K_D614G) | 27097 | 27120 | 27212 |
| 32 | B.1.526 (NewYork) S_stab_PP(K986P_V987P_L5F_T95I_D253G_E484K_D614G_A701V) | 27098 | 27121 | 27213 |
| 33 | B.1.526.2 (NewYork) S_stab_PP(K986P_V987P_L5F_T95I_D253G_S477N_D614G_Q957R) | 27099 | 27122 | 27214 |
| 34 | A.23.1_v1 (Rwanda/Uganda) S_stab_PP(K986P_V987P_F157L_V367F_Q613H_P681R) | 27100 | 27123 | 27215 |
| 35 | A.23.1_v2 (Rwanda/Uganda) S_stab_PP(K986P_V987P_S254F_D614G_P681R_G769V) | 27101 | 27124 | 27216 |
| 36 | B.1.620 (unclear/Africa) S_stab_PP(K986P_V987P_P26S_H69del_V70del_V126A_Y144del_L242del_A243del_L244del_H245Y_S477N_E484K_D614G_P681H_T1027I_D1118H) | 27102 | 27125 | 27217 |
| 37 | B.1.621 (Columbia) S_stab_PP(K986P_V987P_T95I_Y144T_Y145S_ins145N_R346K_E484K_N501Y_D614G_P681H_D950N) | 27103 | 27126 | 27218 |
| 38 | B.1.214.2 (unclear) S_stab_PP(K986P_V987P_ins214TDR_Q414K_N450K_D614G_T716I) | 27104 | 27127 | 27219 |
| 39 | B.1.1.519 (Mexico) S_stab_PP(K986P_V987P_T478K_D614G_P681H_T732A) | 27105 | 27128 | 27220 |
| 40 | P.3 (Philippines) S_stab_PP(K986P_V987P_E484K_N501Y_D614G_P681H_E1092K_H1101Y_V1176F) | 27106 | 27129 | 27221 |
| 41 | B.1.616 (France) S_stab_PP(K986P_V987P_H66D_G142V_Y144del_Y145del_D215G_V483A_D614G_H655Y_G669S_Q949R_N1187D) | 27107 | 27130 | 27222 |
| 42 | v1 (Vietnam) S_stab_PP(K986P_V987P_Y144del_L452R_T478K_P681R) | 27108 | 27131 | 27223 |
| 43 | v2 (Vietnam) S_stab_PP(K986P_V987P_T19R_Y144del_Y145del_L452R_T478K_D614G_P681R) | 27109 | 27132 | 27224 |
| 44 | C.1.2 (SouthAfrica2) S_stab_PP(K986P_V987P_P9L_C136F_Y144del_R190S_D215G_L242del_A243del_Y449H_E484K_N501Y_D614G_H655Y_N679K_T716I_T859N) | 28540 | 28589 | |
| 45 | BA.1_v1 (SouthAfrica3) S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v1) | 28541 | 28590 | |
| 46 | S_stab_PP(K986P BA.1_v0 (SouthAfrica3) S_stab_PP(K986P_V987P_A67V_H69del_V70del_T95I_G142D_V143del_Y144del_Y145del_N211del_L212I_ins214EPE_G339D_S371L_S373P_S375F_K417N_N440K_G446S_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v0) | 28542 | 28591 | |
| 47 | B.1.1.529 (SouthAfrica3) S_stab_PP(K986P_V987P_A67V_T95I_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_B.1.1.529) | 28543 | 28592 | |
| 48 | BA.2 (SouthAfrica3) S_stab_PP(K986P_V987P_T19I_L24del_P25del_P26del_A27S_G142D_V213G_G339D_S371F_S373P_S375F_T376A_D405N_S477N_T478K_E484A_Q493R_ | 28544 | 28593 | |

TABLE 1-continued

| row | A | B | C | D |
|---|---|---|---|---|
| Preferred SARS-CoV-2 constructs (amino acid sequences and nucleic acid coding sequences): | | | | |
| | Q498R__N501Y__Y505H__D614G__H655Y__N679K__P681H__D796Y__Q954H__N969K); S__stab__PP(K986P__V987P__BA.2) | | | |
| 49 | C.37__v2 (Peru/Lima) S__stab__PP(K986P__V987P__G75V__T76I__R246del__S247del__Y248del__L249del__T250del__P251del__G252del__D253N__L452Q__F490S__D614G__T859N) | 28545 | 28594 | |
| 50 | B.1.621__v2 (Columbia) S__stab__PP(K986P__V987P__T95I__Y144S__Y145N__R346K__E484K__N501Y__D614G__P681H__D950N) | 28546 | 28595 | |
| 51 | C.36.3 (Thailand) S__stab__PP(K986P__V987P__S12F__H69del__V70del__W152R__R346S__L452R__D614G__Q677H__A899S) | 28547 | 28596 | |
| 52 | B.1.619 (Cameroon) S__stab__PP(K986P__V987P__I210T__N440K__E484K__D614G__D936N__S939F__T1027I) | 28548 | 28597 | |
| 53 | R.1 (Kentucky) S__stab__PP(K986P__V987P__W152L__E484K__D614G__G769V) | 28549 | 28598 | |
| 54 | B.1.1.176 (Canada) S__stab__PP(K986P__V987P__T20I__R357K__D614G) | 28550 | 28599 | |
| 55 | AZ.3 S__stab__PP(K986P__V987P__T95I__Y144del__E484K__D614G__P681H__D796H) | 28551 | 28600 | |
| 56 | B.1.617.2__v2 (India) S__stab__PP(K986P__V987P__T19R__G142D__E156G__F157del__R158del__L452R__T478K__D614G__P681R__D950N) | 28552 | 28601 | |
| 57 | AY.1 (India) S__stab__PP(K986P__V987P__T19R__T95I__G142D__E156G__F157del__R158del__W258L__K417N__L452R__T478K__D614G__P681R__D950N) | 28553 | 28602 | |
| 58 | AY.2 (India) S__stab__PP(K986P__V987P__T19R__V70F__G142D__E156G__F157del__R158del__A222V__K417N__L452R__T478K__D614G__P681R__D950N) | 28554 | 28603 | |
| 59 | AY.4__v1 (India) S__stab__PP(K986P__V987P__T19R__T95I__G142D__E156G__F157del__R158del__L452R__T478K__D614G__P681R__D950N) | 28555 | 28604 | |
| 60 | AY.4__v2 (India) S__stab__PP(K986P__V987P__T19R__E156G__F157del__R158del__L452R__T478K__D614G__P681R__D950N) | 28556 | 28605 | |
| 61 | AY.4.2 (India) S__stab__PP(K986P__V987P__T19R__T95I__G142D__Y145H__E156G__F157del__R158del__A222V__L452R__T478K__D614G__P681R__D950N) | 28557 | 28606 | |
| 62 | B.1.617.3 (India) S__stab__PP(K986P__V987P__T19R__L452R__E484Q__D614G__P681R__D950N) | 28558 | 28607 | |
| 63 | B.1.617 (India)__w/oFCS S__stab__PP(K986P__V987P__L452R__D614G__P681R__R682del__R683del__A684del__R685del) | 28559 | 28608 | |
| 64 | B.1.617.1 (India)__w/oFCS S__stab__PP(K986P__V987P__E154K__L452R__E484Q__D614G__P681R__R682del__R683del__A684del__R685del__Q1071H) | 28560 | 28609 | |
| 65 | B.1.617.2 (India)__w/oFCS S__stab__PP(K986P__V987P__T19R__F157del__R158del__L452R__T478K__D614G__P681R__R682del__R683del__A684del__R685del__D950N) | 28561 | 28610 | |
| 66 | B.1,617.2__v2 (India)__w/oFCS S__stab__PP(K986P__V987P__T19R__G142D__E156G__F157del__R158del__L452R__T478K__D614G__P681R__R682del__R683del__A684del__R685del__D950N) | 28562 | 28611 | |
| 67 | AY.1 (India)__w/oFCS S__stab__PP(K986P__V987P__T19R__T95I__G142D__E156G__F157del__R158del__W258L__K417N__L452R__T478K__D614G__P681R__R682del__R683del__A684del__R685del__D950N) | 28563 | 28612 | |
| 68 | AY.2 (India)__w/oFCS S__stab__PP(K986P__V987P__T19R__V70F__G142D__E156G__F157del__R158del__A222V__K417N__L452R__T478K__D614G__P681R__R682del__R683del__A684del__R685del__D950N) | 28564 | 28613 | |
| 69 | AY.4__v1 (India)__w/oFCS S__stab__PP(K986P__V987P__T19R__T95I__G142D__E156G__F157del__R158del__L452R__T478K__D614G__P681R__R682del__R683del__A684del__R685del__D950N) | 28565 | 28614 | |
| 70 | AY.4__v2 (India)__w/oFCS S__stab__PP(K986P__V987P__T19R__E156G__F157del__R158del__L452R__T478K__D614G__P681R__R682del__R683del__A684del__R685del__D950N) | 28566 | 28615 | |
| 71 | AY.4.2 (India)__w/oFCS S__stab__PP(K986P__V987P__T19R__T95I__G142D__Y145H__E156G__F157del__R158del__A222V__L452R__T478K__D614G__P681R__R682del__R683del__A684del__R685del__D950N) | 28567 | 28616 | |
| 72 | B.1.617.3 (India)__w/oFCS S__stab__PP(K986P__V987P__T19R__L452R__E484Q__D614G__P681R__R682del__R683del__A684del__R685del__D950N) | 28568 | 28617 | |
| 73 | B.1.617 (India)__withE484K S__stab__PP(K986P__V987P__L452R__E484K__D614G__P681R) | 28569 | 28618 | |
| 74 | B.1.617.1 (India)__withE484K S__stab__PP(K986P__V987P__E154K__L452R__E484K__D614G__P681R__Q1071H) | 28570 | 28619 | |
| 75 | B.1.617.2 (India)__withE484K S__stab__PP(K986P__V987P__T19R__F157del__R158del__L452R__T478K__E484K__D614G__P681R__D950N) | 28571 | 28620 | |

TABLE 1-continued

| Preferred SARS-CoV-2 constructs (amino acid sequences and nucleic acid coding sequences): | | | | |
|---|---|---|---|---|
| row | A | B | C | D |
| 76 | B.1.617.2_v2 (India)_withE484K S_stab_PP(K986P_V987P_T19R_G142D_E156G_F157del_R158del_L452R_T478K_E484K_D614G_P681R_D950N) | 28572 | 28621 | |
| 77 | AY.1 (India)_withE484K S_stab_PP(K986P_V987P_T19R_T95I_G142D_E156G_F157del_R158del_W258L_K417N_L452R_T478K_E484K_D614G_P681R_D950N) | 28573 | 28622 | |
| 78 | AY.2 (India)_withE484K S_stab_PP(K986P_V987P_T19R_V70F_G142D_E156G_F157del_R158del_A222V_K417N_L452R_T478K_E484K_D614G_P681R_D950N) | 28574 | 28623 | |
| 79 | AY.4_v1 (India)_withE484K S_stab_PP(K986P_V987P_T19R_T95I_G142D_E156G_F157del_R158del_L452R_T478K_E484K_D614G_P681R_D950N) | 28575 | 28624 | |
| 80 | AY.4_v2 (India)_withE484K S_stab_PP(K986P_V987P_T19R_E156G_F157del_R158del_L452R_T478K_E484K_D614G_P681R_D950N) | 28576 | 28625 | |
| 81 | AY.4.2 (India)_withE484K S_stab_PP(K986P_V987P_T19R_T95I_G142D_Y145H_E156G_F157del_R158del_A222V_L452R_T478K_E484K_D614G_P681R_D950N) | 28577 | 28626 | |
| 82 | B.1.617.3 (India)_withE484K S_stab_PP(K986P_V987P_T19R_L452R_E484K_D614G_P681R_D950N) | 28578 | 28627 | |
| 83 | B.1.617 (India)_withE484K_w/oFCS S_stab_PP(K986P_V987P_L452R_E484K_D614G_P681R_R682del_R683del_A684del_R685del) | 28579 | 28628 | |
| 84 | B.1.617.1 (India)_withE484K_w/oFCS S_stab_PP(K986P_V987P_E154K_L452R_E484K_D614G_P681R_R682del_R683del_A684del_R685del_Q1071H) | 28580 | 28629 | |
| 85 | B.1.617.2 (India)_withE484K_w/oFCS S_stab_PP(K986P_V987P_T19R_F157del_R158del_L452R_T478K_E484K_D614G_P681R_R682del_R683del_A684del_R685del_D950N) | 28581 | 28630 | |
| 86 | B.1.617.2_v2 (India)_withE484K_w/oFCS S_stab_PP(K986P_V987P_T19R_G142D_E156G_F157del_R158del_L452R_T478K_E484K_D614G_P681R_R682del_R683del_A684del_R685del_D950N) | 28582 | 28631 | |
| 87 | AY.1 (India)_withE484K_w/oFCS S_stab_PP(K986P_V987P_T19R_T95I_G142D_E156G_F157del_R158del_W258L_K417N_L452R_T478K_E484K_D614G_P681R_R682del_R683del_A684del_R685del_D950N) | 28583 | 28632 | |
| 88 | AY.2 (India)_withE484K_w/oFCS S_stab_PP(K986P_V987P_T19R_V70F_G142D_E156G_F157del_R158del_A222V_K417N_L452R_T478K_E484K_D614G_P681R_R682del_R683del_A684del_R685del_D950N) | 28584 | 28633 | |
| 89 | AY.4_v1 (India)_withE484K_w/oFCS S_stab_PP(K986P_V987P_T19R_T95I_G142D_E156G_F157del_R158del_L452R_T478K_E484K_D614G_P681R_R682del_R683del_A684del_R685del_D950N) | 28585 | 28634 | |
| 90 | AY.4_v2 (India)_withE484K_w/oFCS S_stab_PP(K986P_V987P_T19R_E156G_F157del_R158del_L452R_T478K_E484K_D614G_P681R_R682del_R683del_A684del_R685del_D950N) | 28586 | 28635 | |
| 91 | AY.4.2 (India)_withE484K_w/oFCS S_stab_PP(K986P_V987P_T19R_T95I_G142D_Y145H_E156G_F157del_R158del_A222V_L452R_T478K_E484K_D614G_P681R_R682del_R683del_A684del_R685del_D950N) | 28587 | 28636 | |
| 92 | B.1.617.3 (India)_withE484K_w/oFCS S_stab_PP(K986P_V987P_T19R_L452R_E484K_D614G_P681R_R682del_R683del_A684del_R685del_D950N) | 28588 | 28637 | |
| 93 | BA.1_v2 (SouthAfrica3) S_stab_PP(K986P_V987P_A67V_H69del_V70del_T95I_G142D_V143del_Y144del_Y145del_N211del_L212I_ins214EPE_G339D_S371L_S373P_S375F_N440K_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v2) | 28917 | 28921 | |
| 94 | BA.1_v3 (SouthAfrica3) S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_BA.1_v3) | 28918 | 28922 | |
| 95 | BA.1_v4 (SouthAfrica3) S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_A701V_N764K_D796Y_N856K_Q954H_N969K_L981F); S_stab_PP(K986P_V987P_BA.1_v4) | 28919 | 28923 | |

TABLE 1-continued

| Preferred SARS-CoV-2 constructs (amino acid sequences and nucleic acid coding sequences): | | | | |
|---|---|---|---|---|
| row | A | B | C | D |
| 96 | BA.1_v5 (SouthAfrica3) S_stab_PP(K986P_V987P_A67V_H69del_V70del_T95I_G142D_V143del_Y144del_Y145del_N211del_L212I_ins214EPE_G339D_S371L_S373P_S375F_G446S_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v5) | 28920 | 28924 | |

w/oFCS: deleted furin cleavage site

Suitable Coding Sequences:

According to preferred embodiments, the RNA of the invention comprises at least one coding sequence encoding at least one antigenic peptide or protein selected from or derived from a SARS-CoV-2 spike protein, preferably as defined above, or fragments and variants thereof. In that context, any coding sequence encoding at least one antigenic protein SARS-CoV-2 spike protein as defined herein, or fragments and variants thereof may be understood as suitable coding sequence and may therefore be comprised in the RNA of the invention.

In preferred embodiments, the RNA of the first aspect may comprise or consist of at least one coding sequence encoding at least one antigenic peptide or protein from SARS-CoV-2 as defined herein, preferably encoding any one of SEQ ID NOs: 1, 10, 22738, 22740, 22742, 22744, 22746, 22748, 22750, 22752, 22754, 22756, 22758, 22959-22964, 27087-27109, 28540-28588, 28917-28920 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 116, 136, 137, 146, 22765, 22767, 22769, 22771, 22773, 22775, 22777, 22779, 22781, 22783, 22785, 23089-23148, 23150-23184, 27110-27247, 28589-28637, 28916, 28921-28924 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NOs: 116, 136, 137, 146, 22765, 22767, 22769, 22771, 22773, 22775, 22777, 22779, 22781, 22783, 22785, 23089-23148, 23150-23184, 27110-27247, 28589-28637, 28916, or 28921-28924.

In preferred embodiments, the RNA of the first aspect may comprise or consist of at least one coding sequence encoding at least one antigenic peptide or protein from SARS-CoV-2 as defined herein, preferably encoding any one of SEQ ID NOs: 10, 22738, 22740, 22742, 22744, 22746, 22748, 22750, 22752, 22754, 22756, 22758, 22959-22964, 27087-27109, 28540-28588, 28917-28920 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 137, 146, 22765, 22767, 22769, 22771, 22773, 22775, 22777, 22779, 22781, 22783, 22785, 23089-23148, 23150-23184, 23095-23112, 27110-27247, 28589-28637, 28921-28924 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NOs: 137, 146, 22765, 22767, 22769, 22771, 22773, 22775, 22777, 22779, 22781, 22783, 22785, 23089-23148, 23150-23184, 27110-27247 28589-28637, or 28921-28924.

In preferred embodiments, the RNA of the first aspect may comprise or consist of at least one coding sequence encoding at least one antigenic peptide or protein from SARS-CoV-2 as defined herein, preferably encoding any one of SEQ ID NOs: 10, 22738, 22740, 22742, 22744, 22746, 22748, 22750, 22752, 22754, 22756, 22758, 22959-22964, 27087-27109, 28540-28588, 28917-28920 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 137, 22765, 22767, 22769, 22771, 22773, 22775, 22777, 22779, 22781, 22783, 22785, 23089-23148, 27110-27201, 28589-28637, 28921-28924 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NOs: 137, 22765, 22767, 22769, 22771, 22773, 22775, 22777, 22779, 22781, 22783, 22785, 23089-23148, 27110-27201, 28589-28637, or 28921-28924.

In preferred embodiments, the RNA of the first aspect may comprise or consist of at least one coding sequence encoding at least one antigenic peptide or protein from SARS-CoV-2 as defined herein, preferably encoding any one of SEQ ID NOs: 10, 22738, 22740, 22742, 22744, 22746, 22748, 22750, 22752, 22754, 22756, 22758, 22959-22964, 27087-27109, 28540-28588, 28917-28920 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 146, 23150-23184, 27202-27247 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NOs: 146, 23150-23184 or 27202-27247.

In preferred embodiments, the RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 22765, 22767, 22769, 22771, 22773, 22775, 22777, 22779, 22781, 22783, 22785, 23089-23148, 23150-23184, 27110-27247, 28589-28637, 28921-28924 or a fragment or a fragment or variant of any of these sequences. In certain embodiments the RNA sequence which encodes a SARS-CoV-2 spike protein is at least 95% identical to any one of SEQ ID NOs: 22765, 22767, 22769, 22771, 22773, 22775, 22777, 22779, 22781, 22783, 22785, 23089-23148, 23150-23184, 27110-27247, 28589-28637, or 28921-28924. Additional information regarding each of these suitable nucleic acid sequences may also be derived from the sequence listing, in particular from the details provided therein under identifier <223>.

In preferred embodiments, the RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 22765, 22767, 22769, 22771, 22773, 22775, 22777, 22779, 22781, 22783, 22785, 23089-23094, 27110-27132, 28589-28637, or 28921-28924 or a fragment or a fragment or variant of any of these sequences. In certain embodiments the RNA sequence which encodes a SARS-CoV-2 spike protein is at least 95% identical to any one of SEQ ID NOs: 22765, 22767, 22769, 22771, 22773, 22775, 22777, 22779, 22781, 22783, 22785, 23089-23094, 27110-27132, 28589-28637, or 28921-28924.

In preferred embodiments, the RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 23150-23166 or 27202-27224 or a fragment or a fragment or variant of any of these sequences. In certain embodiments the RNA sequence which encodes a SARS-CoV-2 spike protein is at least 95% identical to any one of SEQ ID NOs: 23150-23166 or 27202-27224.

In preferred embodiments, the RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 23150-23166, 27202-27224, 23114-23130 or 27156-27178 or a fragment or a fragment or variant of any of these sequences. In certain embodiments the RNA sequence which encodes a SARS-CoV-2 spike protein is at least 95% identical to any one of SEQ ID NOs: 23114-23130 or 27156-27178.

In preferred embodiments, the RNA of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 23150-23166, 27202-27224, 23167-23184 or 27225-27247 or a fragment or a fragment or variant of any of these sequences. In certain embodiments the RNA sequence which encodes a SARS-CoV-2 spike protein is at least 95% identical to any one of SEQ ID NOs: 23167-23184 or 27225-27247.

In preferred embodiments, the RNA of the first aspect is an artificial RNA.

The term "artificial RNA" as used herein is intended to refer to an RNA that does not occur naturally. In other words, an artificial RNA may be understood as a non-natural RNA molecule. Such RNA molecules may be non-natural due to its individual sequence (e.g. G/C content modified coding sequence, UTRs) and/or due to other modifications, e.g. structural modifications of nucleotides. Typically, artificial RNA may be designed and/or generated by genetic engineering to correspond to a desired artificial sequence of nucleotides. In this context, an artificial RNA is a sequence that may not occur naturally, i.e. a sequence that differs from the wild type sequence/the naturally occurring sequence by at least one nucleotide. The term "artificial RNA" is not restricted to mean "one single RNA molecule" but is understood to comprise an ensemble of essentially identical RNA molecules. Accordingly, it may relate to a plurality of essentially identical RNA molecules.

In preferred embodiments, the RNA of the first aspect is a modified and/or stabilized RNA, preferably a modified and/or stabilized artificial RNA.

According to preferred embodiments, the RNA of the present invention may thus be provided as a "stabilized artificial RNA" or "stabilized coding RNA" that is to say an RNA showing improved resistance to in vivo degradation and/or an RNA showing improved stability in vivo, and/or an RNA showing improved translatability in vivo. In the following, specific suitable modifications/adaptations in this context are described which are suitably to "stabilize" the RNA. Preferably, the RNA of the present invention may be provided as a "stabilized RNA" or "stabilized coding RNA".

Such stabilization may be affected by providing a "dried RNA" and/or a "purified RNA" as further specified below. Alternatively, or in addition to that, such stabilization can be affected, for example, by a modified phosphate backbone of the RNA of the present invention. A backbone modification in connection with the present invention is a modification in which phosphates of the backbone of the nucleotides contained in the nucleic acid are chemically modified. Nucleotides that may be used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, suitable modifications are described that are capable of "stabilizing" the RNA of the invention.

In preferred embodiments, the RNA comprises at least one codon modified coding sequence.

In preferred embodiments, the at least one coding sequence of the RNA is a codon modified coding sequence, wherein the amino acid sequence encoded by the at least one codon modified coding sequence is preferably not being modified compared to the amino acid sequence encoded by the corresponding wild type coding sequence or reference coding sequence.

The term "codon modified coding sequence" relates to coding sequences that differ in at least one codon (triplets of nucleotides coding for one amino acid) compared to the corresponding wild type or reference coding sequence. Suitably, a codon modified coding sequence in the context of the invention may show improved resistance to in vivo degradation and/or improved stability in vivo, and/or improved translatability in vivo. Codon modifications in the broadest sense make use of the degeneracy of the genetic code wherein multiple codons may encode the same amino acid and may be used interchangeably to optimize/modify the coding sequence for in vivo applications.

The term "reference coding sequence" relates to the coding sequence, which was the origin sequence to be modified and/or optimized.

In preferred embodiments, the at least one coding sequence of the RNA is a codon modified coding sequence, wherein the codon modified coding sequence is selected from C maximized coding sequence, CAI maximized coding sequence, human codon usage adapted coding sequence, G/C content modified coding sequence, and G/C optimized coding sequence, or any combination thereof.

In preferred embodiments, the at least one coding sequence of the RNA has a G/C content of at least about 50%, 55%, or 60%. In particular embodiments, the at least one coding sequence of the RNA of component A has a G/C content of at least about 50%, 51%, 52%, 53%, 54%, 55%, 56%, 57%, 58%, 59%, 60%, 61%, 62%, 63%, 64%, 65%, 66%, 67%, 68%, 69%, or 70%.

When transfected into mammalian host cells, the RNA comprising a codon modified coding sequence has a stability of between 12-18 hours, or greater than 18 hours, e.g., 24, 36, 48, 60, 72, or greater than 72 hours and are capable of being expressed by the mammalian host cell (e.g. a muscle cell).

When transfected into mammalian host cells, the RNA comprising a codon modified coding sequence is translated into protein, wherein the amount of protein is at least comparable to, or preferably at least 10% more than, or at least 20% more than, or at least 30% more than, or at least 40% more than, or at least 50% more than, or at least 100% more than, or at least 200% or more than the amount of protein obtained by a naturally occurring or wild type or reference coding sequence transfected into mammalian host cells.

In some embodiments, the RNA may be modified, wherein the C content of the at least one coding sequence may be increased, preferably maximized, compared to the C content of the corresponding wild type or reference coding sequence (herein referred to as "C maximized coding sequence"). The generation of a C maximized nucleic acid sequences may suitably be carried out using a modification method according to WO2015/062738. In this context, the disclosure of WO2015/062738 is included herewith by reference.

In preferred embodiments, the RNA may be modified, wherein the G/C content of the at least one coding sequence may be optimized compared to the G/C content of the corresponding wild type or reference coding sequence (herein referred to as "G/C content optimized coding sequence"). "Optimized" in that context refers to a coding sequence wherein the G/C content is preferably increased to the essentially highest possible G/C content. The generation of a G/C content optimized RNA sequences may be carried out using a method according to WO2002/098443. In this context, the disclosure of WO2002/098443 is included in its full scope in the present invention. Throughout the description, including the <223> identifier of the sequence listing, G/C optimized coding sequences are indicated by the abbreviations "opt1" or "gc".

In preferred embodiments, the RNA may be modified, wherein the codons in the at least one coding sequence may be adapted to human codon usage (herein referred to as "human codon usage adapted coding sequence"). Codons encoding the same amino acid occur at different frequencies in humans. Accordingly, the coding sequence of the nucleic acid is preferably modified such that the frequency of the codons encoding the same amino acid corresponds to the naturally occurring frequency of that codon according to the human codon usage. For example, in the case of the amino acid Ala, the wild type or reference coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. Accordingly, such a procedure (as exemplified for Ala) is applied for each amino acid encoded by the coding sequence of the nucleic acid to obtain sequences adapted to human codon usage. Throughout the description, including the <223> identifier of the sequence listing, human codon usage adapted coding sequences are indicated by the abbreviation "opt3" or "human".

In some embodiments, the RNA may be modified, wherein the G/C content of the at least one coding sequence may be modified compared to the G/C content of the corresponding wild type or reference coding sequence (herein referred to as "G/C content modified coding sequence"). In this context, the terms "G/C optimization" or "G/C content modification" relate to a nucleic acid that comprises a modified, preferably an increased number of guanosine and/or cytosine nucleotides as compared to the corresponding wild type or reference coding sequence. Such an increased number may be generated by substitution of codons containing adenosine or thymidine nucleotides by codons containing guanosine or cytosine nucleotides. Advantageously, nucleic acid sequences having an increased G/C content are more stable or show a better expression than sequences having an increased A/U. Preferably, the G/C content of the coding sequence of the nucleic acid is increased by at least 10%, 20%, 30%, preferably by at least 40% compared to the G/C content of the coding sequence of the corresponding wild type or reference nucleic acid sequence (herein referred to "opt 10" or "gc mod"). For example, the the G/C content of the coding sequence of the nucleic acid is preferably increased by at least 10%, 15%, 16%, 17%, 18%, 19%, 20%, 21%, 22%, 23%, 24% or 25% relative to the G/C content of SEQ ID NO: 28916.

In some embodiments, the RNA may be modified, wherein the codon adaptation index (CAI) may be increased or preferably maximised in the at least one coding sequence (herein referred to as "CAI maximized coding sequence"). It is preferred that all codons of the wild type or reference nucleic acid sequence that are relatively rare in e.g. a human are exchanged for a respective codon that is frequent in the e.g. a human, wherein the frequent codon encodes the same amino acid as the relatively rare codon. Suitably, the most frequent codons are used for each amino acid of the encoded protein. Suitably, the RNA comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1 (CAI=1). For example, in the case of the amino acid Ala, the wild type or reference coding sequence may be adapted in a way that the most frequent human codon "GCC" is always used for said amino acid. Accordingly, such a procedure (as exemplified for Ala) may be applied for each amino acid encoded by the coding sequence of the nucleic acid to obtain CAI maximized coding sequences.

In particularly preferred embodiments, the at least one coding sequence of the nucleic acid is a codon modified coding sequence, wherein the codon modified coding sequence is a G/C optimized coding sequence.

In particularly preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a G/C optimized nucleic acid sequence selected from the group consisting of SEQ ID NOs: 137, 22765, 22767, 22769, 22771, 22773, 22775, 22777, 22779, 22781, 22783, 22785, 23089-23148, 27110-27201, 28589-28637, 28921-28924 or a fragment or variant of any of these sequences.

In particularly preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a G/C optimized nucleic acid sequence selected from the group consisting of SEQ ID NOs: 146, 23150-23184, 27202-27247 or a fragment or variant of any of these sequences.

In even more preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 23090, 23108, 23126, 23144, 23162, 23180, 23091, 23109, 23127, 23145, 23163, 23181, 28589 (B.1.315; C.1.2) or a fragment or variant of any of these sequences. In some aspects, the at least one coding sequence encoding the SARS-CoV-2 antigen is at least 95% identical to SEQ ID NOs: 23090, 23108, 23126, 23144, 23162, 23180, 23091, 23109, 23127, 23145, 23163, 23181 or 28589. In some aspects, the at least one coding sequence encoding the SARS-CoV-2 antigen is at least 95% identical to SEQ ID NOs: 23090-23091, 23162-23163 or 28589.

In even more preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 27116, 27139, 27162, 27185, 27208, 27231, 27117, 27140, 27163, 27186, 27209, 27232, 27118, 27141, 27164, 27187, 27210, 27233, 28601-28607 (B.1.617; 8.1.617.1; 8.1.617.2; AY.1; AY.2; AY.4; AY.4.2; 8.1.617.3) or a fragment or variant of any of these sequences. In some aspects, the at least one coding sequence encoding the SARS-CoV-2 antigen is at least 95% identical to SEQ ID NOs: 27116, 27139, 27162, 27185, 27208, 27231, 27117, 27140, 27163, 27186, 27209, 27232, 27118, 27141, 27164, 27187, 27210, 27233, or 28601-28607. In some aspects, the at least one coding sequence encoding the SARS-CoV-2 antigen is at least 95% identical to SEQ ID NOs: 27116-27118 27208-27210 or 28601-28607.

In even more preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 27118, 27141, 27164, 27187, 27210, 27233 or 28601-28606 (B.1.617.2; AY.1; AY.2; AY.4; AY.4.2) or a fragment or variant of any of these sequences. In some aspects, the at least one coding sequence encoding the SARS-CoV-2 antigen is at least 95% identical to SEQ ID NOs: 27118, 27141, 27164, 27187, 27210, 27233 or 28601-28606. In some aspects, the at least one coding sequence encoding the SARS-CoV-2 antigen is at least 95% identical to SEQ ID NOs: 27118, 27210 or 28601-28606.

In even more preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 27118, 27141, 27164, 27187, 27210 or 27233 (B.1.617.2) or a fragment or variant of any of these sequences. In some aspects, the at least one coding sequence encoding the SARS-CoV-2 antigen is at least 95% identical to SEQ ID NOs: 27118, 27141, 27164, 27187, 27210 or 27233. In some aspects, the at least one coding sequence encoding the SARS-CoV-2 antigen is at least 95% identical to SEQ ID NOs: 27118 or 27210.

In further preferred embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 28590-28593, 28921-28924 (B.1.1.529, Omicron) or a fragment or variant of any of these sequences. In some aspects, the at least one coding sequence encoding the SARS-CoV-2 antigen is at least 95% identical to SEQ ID NOs: 28590-28593. In some aspects, the at least one coding sequence encoding the SARS-CoV-2 antigen is at least 95% identical to SEQ ID NOs: 28590-28593, 28921-28924.

UTRs:

In preferred embodiments, the RNA of the invention comprises at least one coding sequence encoding at least one SARS-CoV-2 spike protein as defined herein, or an immunogenic fragment or immunogenic variant thereof, wherein the RNA comprises at least one heterologous untranslated region (UTR). In some aspects a RNA of the embodiments does not comprise a 3' UTR comprising the sequence of SEQ ID NO: 268. In certain aspects, a RNA of the embodiments comprises a 3' UTR comprising the sequence of SEQ ID NO: 268

In preferred embodiments, the RNA of the invention comprises a protein-coding region ("coding sequence" or "cds"), and 5'-UTR and/or 3'-UTR. Notably, UTRs may harbor regulatory sequence elements that determine nucleic acid, e.g. RNA turnover, stability, and localization. Moreover, UTRs may harbor sequence elements that enhance translation. In medical applications, translation of the RNA into at least one peptide or protein is of paramount importance to therapeutic efficacy. Certain combinations of 3'-UTRs and/or 5'-UTRs may enhance the expression of operably linked coding sequences encoding peptides or proteins of the invention. RNA molecules harboring said UTR combinations advantageously enable rapid and transient expression of antigenic peptides or proteins after administration to a subject, preferably after intramuscular administration. Accordingly, the RNA comprising certain combinations of 3'-UTRs and/or 5'-UTRs as provided herein is particularly suitable for administration as a vaccine, in particular, suitable for administration into the muscle, the dermis, or the epidermis of a subject.

Suitably, the RNA of the invention comprises at least one heterologous 5'-UTR and/or at least one heterologous 3'-UTR. Said heterologous 5'-UTRs or 3'-UTRs may be derived from naturally occurring genes or may be synthetically engineered. In preferred embodiments, the RNA comprises at least one coding sequence as defined herein operably linked to at least one (heterologous) 3'-UTR and/or at least one (heterologous) 5'-UTR.

In preferred embodiments, the RNA comprises at least one heterologous 3'-UTR, wherein the RNA does not comprise a 3'-UTR comprising the sequence of SEQ ID NO: 268. Preferably, the RNA comprises a 3'-UTR, which may be derivable from a gene that relates to an RNA with enhanced half-life (i.e. that provides a stable RNA).

In some embodiments, a 3'-UTR comprises one or more of a polyadenylation signal, a binding site for proteins that affect a nucleic acid stability or location in a cell, or one or more miRNA or binding sites for miRNAs.

MicroRNAs (or miRNA) are 19-25 nucleotide long noncoding RNAs that bind to the 3'-UTR of nucleic acid molecules and down-regulate gene expression either by reducing nucleic acid molecule stability or by inhibiting translation. E.g., microRNAs are known to regulate RNA, and thereby protein expression, e.g. in liver (miR-122), heart (miR-Id, miR-149), endothelial cells (miR-17-92, miR-126), adipose tissue (let-7, miR-30c), kidney (miR-192, miR-194, miR-204), myeloid cells (miR-142-3p, miR-142-5p, miR-16, miR-21, miR-223, miR-24, miR-27), muscle (miR-133, miR-206, miR-208), and lung epithelial cells (let-7, miR-133, miR-126). The RNA may comprise one or more microRNA target sequences, microRNA sequences, or microRNA seeds. Such sequences may e.g. correspond to any known microRNA such as those taught in US2005/0261218 and US2005/0059005.

Accordingly, miRNA, or binding sites for miRNAs as defined above may be removed from the 3'-UTR or introduced into the 3'-UTR in order to tailor the expression of the RNA to desired cell types or tissues (e.g. muscle cells).

In preferred embodiments, the RNA comprises at least one heterologous 3'-UTR that comprises or consists of a nucleic acid sequence derived from a 3'-UTR of a gene selected from PSMB3, ALB7, CASP1, COX6B1, GNAS, NDUFA1 and RPS9, or from a homolog, a fragment or a variant of any one of these genes. In some embodiments, the RNA comprises at least one heterologous 3'-UTR, wherein the at least one heterologous 3'-UTR comprises a nucleic acid sequence derived from a 3'-UTR of a gene selected from PSMB3, ALB7, CASP1, COX6B1, GNAS, NDUFA1 and RPS9, or from a homolog, a fragment or variant of any one of these genes, preferably according to nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 253-266, 22902-22905, 22876-22895, 26996-26999, 28528-28539 or a fragment or a variant of any of these. Particularly preferred nucleic acid sequences in that context can be derived from published PCT application WO2019/077001A1, in particular, claim 9 of WO2019/077001A1. The corresponding 3'-UTR sequences of claim 9 of WO2019/077001A1 are herewith incorporated by reference (e.g., SEQ ID NOs: 23-34 of WO2019/077001A1, or fragments or variants thereof).

In further embodiments, the RNA comprises a 3'-UTR derived from a RPS9 gene. Said 3'-UTR derived from a RPS9 gene may comprise or consist of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 263 or 264, 22894, 22895, 22904, 22905 or a fragment or a variant thereof.

In preferred embodiments, the RNA comprises a 3'-UTR derived from a PSMB3 gene. Said 3'-UTR derived from a PSMB3 gene may comprise or consist of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 253 or 254, 22892, 22893, 22902, 22903, 26996-26999, 28528-28539 or a fragment or a variant thereof.

In other embodiments, the RNA comprises a 3'-UTR which comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 22876-22891, 28526, 28527 or a fragment or a variant thereof.

In other embodiments, the RNA may comprise a 3'-UTR as described in WO2016/107877, the disclosure of WO2016/107877 relating to 3'-UTR sequences herewith incorporated by reference. Suitable 3'-UTRs are SEQ ID NOs: 1-24 and SEQ ID NOs: 49-318 of WO2016/107877, or fragments or variants of these sequences. In other embodiments, the nucleic acid comprises a 3'-UTR as described in WO2017/036580, the disclosure of WO2017/036580 relating to 3'-UTR sequences herewith incorporated by reference. Suitable 3'-UTRs are SEQ ID NOs: 152-204 of WO2017/036580, or fragments or variants of these sequences. In other embodiments, the nucleic acid comprises a 3'-UTR as described in WO2016/022914, the disclosure of WO2016/022914 relating to 3'-UTR sequences herewith incorporated by reference. Particularly preferred 3'-UTRs are nucleic acid sequences according to SEQ ID NOs: 20-36 of WO2016/022914, or fragments or variants of these sequences.

In preferred embodiments, the RNA comprises at least one heterologous 5'-UTR.

The terms "5'-untranslated region" or "5'-UTR" or "5'-UTR element" will be recognized and understood by the person of ordinary skill in the art, and are e.g. intended to refer to a part of an RNA molecule located 5' (i.e. "upstream") of a coding sequence and which is not translated into protein. A 5'-UTR may be part of a nucleic acid located 5' of the coding sequence. Typically, a 5'-UTR starts with the transcriptional start site and ends before the start codon of the coding sequence. A 5'-UTR may comprise elements for controlling gene expression, also called regulatory elements. Such regulatory elements may be, e.g., ribosomal binding sites, miRNA binding sites etc. The 5'-UTR may be post-transcriptionally modified, e.g. by enzymatic or post-transcriptional addition of a 5'-cap structure (e.g. for mRNA).

Preferably, the RNA comprises a 5'-UTR which may be derivable from a gene that relates to an RNA with enhanced half-life (i.e. that provides a stable RNA).

In some embodiments, a 5'-UTR comprises one or more of a binding site for proteins that affect an RNA stability or RNA location in a cell, or one or more miRNA or binding sites for miRNAs (as defined above).

Accordingly, miRNA or binding sites for miRNAs as defined above may be removed from the 5'-UTR or introduced into the 5'-UTR in order to tailor the expression of the nucleic acid to desired cell types or tissues (e.g. muscle cells).

In preferred embodiments, the RNA comprises at least one heterologous 5'-UTR, wherein the at least one heterologous 5'-UTR comprises a nucleic acid sequence derived from a 5'-UTR of gene selected from HSD17B4, RPL32, ASAH1, ATP5A1, MP68, NDUFA4, NOSIP, RPL31, SLC7A3, TUBB4B, and UBQLN2, or from a homolog, a fragment or variant of any one of these genes according to nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 231-252, 22870-22875 or a fragment or a variant of any of these. Particularly preferred nucleic acid sequences in that context can be selected from published PCT application WO2019/077001A1, in particular, claim 9 of WO2019/077001A1. The corresponding 5'-UTR sequences of claim 9 of WO2019/077001A1 are herewith incorporated by reference (e.g., SEQ ID NOs: 1-20 of WO2019/077001A1, or fragments or variants thereof).

In preferred embodiments, the RNA comprises a 5'-UTR derived from a RPL31 gene, wherein said 5'-UTR derived from a RPL31 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 243, 244, 22872, 22873 or a fragment or a variant thereof.

In other embodiments, the RNA comprises a 5'-UTR derived from a SLC7A3 gene, wherein said 5'-UTR derived from a SLC7A3 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 245, 246, 22874, 22875 or a fragment or a variant thereof.

In particularly preferred embodiments, the RNA comprises a 5'-UTR derived from a HSD17B4 gene, wherein said 5'-UTR derived from a HSD17B4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 231, 232, 22870, 22871 or a fragment or a variant thereof.

In other embodiments, the RNA comprises a 5'-UTR which comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 22848-22867, 28522-28525 or a fragment or a variant thereof.

In other embodiments, the RNA comprises a 5'-UTR as described in WO2013/143700, the disclosure of WO2013/143700 relating to 5'-UTR sequences herewith incorporated by reference. Particularly preferred 5'-UTRs are nucleic acid sequences derived from SEQ ID NOs: 1-1363, SEQ ID NO: 1395, SEQ ID NO: 1421 and SEQ ID NO: 1422 of WO2013/143700, or fragments or variants of these sequences. In other embodiments, the nucleic acid comprises a 5'-UTR as described in WO2016/107877, the disclosure of WO2016/107877 relating to 5'-UTR sequences herewith incorporated by reference. Particularly preferred 5'-UTRs are nucleic acid sequences according to SEQ ID NOs: 25-30 and SEQ ID NOs: 319-382 of WO2016/107877, or fragments or variants of these sequences. In other embodiments, the nucleic acid comprises a 5'-UTR as described in WO2017/036580, the disclosure of WO2017/036580 relating to 5'-UTR sequences herewith incorporated by reference. Particularly preferred 5'-UTRs are nucleic acid sequences according to SEQ ID NOs: 1-151 of WO2017/036580, or fragments or variants of these sequences. In other embodiments, the nucleic acid comprises a 5'-UTR as described in WO2016/022914, the disclosure of WO2016/022914 relating to 5'-UTR sequences herewith incorporated by reference. Particularly preferred 5'-UTRs are nucleic acid sequences according to SEQ ID NOs: 3-19 of WO2016/022914, or fragments or variants of these sequences.

Suitably, in preferred embodiments, the RNA comprises at least one coding sequence as specified herein encoding at least one antigenic protein as defined herein, preferably derived from SARS-CoV-2 operably linked to a 3'-UTR and/or a 5'-UTR selected from the following 5'UTR/3'UTR combinations ("also referred to UTR designs"): a-1 (HSD17B4/PSMB3), a-2 (NDUFA4/PSMB3), a-3 (SLC7A3/PSMB3), a-4 (NOSIP/PSMB3), a-5 (MP68/PSMB3), b- 1 (UBQLN2/RPS9), b-2 (ASAH1/RPS9), b-3 (HSD17B4/RPS9), b-4 (HSD17B4/CASP1), b-5 (NOSIP/COX6B1), c-1 (NDUFA4/RPS9), c-2 (NOSIP/NDUFA1), c-3 (NDUFA4/COX6B1), c-4 (NDUFA4/NDUFA1), c-5 (ATP5A1/PSMB3), d-1 (Rpl31/PSMB3), d-2 (ATP5A1/CASP1), d-3 (SLC7A3/GNAS), d-4 (HSD17B4/NDUFA1), d-5 (Slc7a3/Ndufa1), e-1 (TUBB4B/RPS9), e-2 (RPL31/RPS9), e-3 (MP68/RPS9), e-4 (NOSIP/RPS9), e-5 (ATP5A1/RPS9), e-6 (ATP5A1/COX6B1), f-1 (ATP5A1/GNAS), f-2 (ATP5A1/NDUFA1), f-3 (HSD17B4/COX6B1), f-4 (HSD17B4/GNAS), f-(MP68/COX6B1), g-1 (MP68/NDUFA1), g-2 (NDUFA4/CASP1), g-3 (NDUFA4/GNAS), g-4 (NOSIP/CASP1), g-5 (RPL31/CASP1), h-1 (RPL31/COX6B1), h-2 (RPL31/GNAS), h-3 (RPL31/NDUFA1), h-4 (Slc7a3/CASP1), h-5 (SLC7A3/COX6B1), i-1 (SLC7A3/RPS9), i-2 (RPL32/ALB7), i-2 (RPL32/ALB7).

In particularly preferred embodiments, the RNA comprises at least one coding sequence as specified herein encoding at least one antigenic protein derived from SARS-CoV-2, wherein said coding sequence is operably linked to a HSD17B4 5'-UTR and a PSMB3 3'-UTR (HSD17B4/PSMB3 (UTR design a-1)).

It has been shown by the inventors that this embodiment is particularly beneficial for induction an immune response against SARS-CoV-2. In this context, it was shown that already one vaccination was sufficient to result in virus-neutralizing antibody titers.

In further preferred embodiments, the nucleic acid comprises at least one coding sequence as specified herein encoding at least one antigenic protein as defined herein, preferably derived from SARS-CoV-2 (nCoV-2019) coronavirus, wherein said coding sequence is operably linked to a SLC7A3 5'-UTR and a PSMB3 3'-UTR (SLC7A3/PSMB3 (UTR design a-3)).

In further preferred embodiments, the nucleic acid comprises at least one coding sequence as specified herein encoding at least one antigenic protein as defined herein, preferably derived from SARS-CoV-2 (nCoV-2019) coronavirus, wherein said coding sequence is operably linked to a RPL31 5'-UTR and a RPS9 3'-UTR (RPL31/RPS9 (UTR design e-2)).

In some embodiments, the RNA may be monocistronic, bicistronic, or multicistronic.

The term "monocistronic" will be recognized and understood by the person of ordinary skill in the art, and is e.g. intended to refer to a nucleic acid that comprises only one coding sequence. The terms "bicistronic", or "multicistronic" as used herein will be recognized and understood by the person of ordinary skill in the art, and are e.g. intended to refer to a nucleic acid that may comprise two (bicistronic) or more (multicistronic) coding sequences.

In preferred embodiments, the RNA of the first aspect is monocistronic.

In other embodiments, the RNA is monocistronic and the coding sequence of said nucleic acid encodes at least two different antigenic peptides or proteins derived from a SARS-CoV-2. Accordingly, said coding sequence may encode at least two, three, four, five, six, seven, eight and more antigenic peptides or proteins derived from a SARS-CoV-2, linked with or without an amino acid linker sequence, wherein said linker sequence can comprise rigid linkers, flexible linkers, cleavable linkers, or a combination thereof. Such constructs are herein referred to as "multi-antigen-constructs".

In further embodiments, the RNA may be bicistronic or multicistronic and comprises at least two coding sequences, wherein the at least two coding sequences encode two or more different antigenic peptides or proteins derived from a SARS-CoV-2. Accordingly, the coding sequences in a bicistronic or multicistronic nucleic acid suitably encodes distinct antigenic proteins or peptides as defined herein or immunogenic fragments or immunogenic variants thereof. Preferably, the coding sequences in said bicistronic or multicistronic constructs may be separated by at least one IRES (internal ribosomal entry site) sequence. Thus, the term "encoding two or more antigenic peptides or proteins" may mean, without being limited thereto, that the bicistronic or multicistronic nucleic acid encodes e.g. at least two, three, four, five, six or more (preferably different) antigenic peptides or proteins of different SARS-CoV-2 isolates. Alternatively, the bicistronic or multicistronic nucleic acid may encode e.g. at least two, three, four, five, six or more (preferably different) antigenic peptides or proteins derived from the same SARS-CoV-2. In that context, suitable IRES sequences may be selected from the list of nucleic acid sequences according to SEQ ID NOs: 1566-1662 of the patent application WO2017/081082, or fragments or variants of these sequences. In this context, the disclosure of WO2017/081082 relating to IRES sequences is herewith incorporated by reference.

It has to be understood that, in the context of the invention, certain combinations of coding sequences may be generated by any combination of monocistronic, bicistronic and multicistronic RNA constructs and/or multi-antigen-constructs to obtain a nucleic acid set encoding multiple antigenic peptides or proteins as defined herein.

In preferred embodiments, the A/U (A/T) content in the environment of the ribosome binding site of the RNA may be increased compared to the A/U (A/T) content in the environment of the ribosome binding site of its respective wild type or reference RNA. This modification (an increased A/U (A/T) content around the ribosome binding site) increases the efficiency of ribosome binding to the RNA. An effective binding of the ribosomes to the ribosome binding site in turn has the effect of an efficient translation the RNA.

Accordingly, in a particularly preferred embodiment, the RNA comprises a ribosome binding site, also referred to as "Kozak sequence", identical to or at least 80%, 85%, 90%, 95% identical to any one of the sequences SEQ ID NOs: 180, 181, 22845-22847, or fragments or variants thereof.

In preferred embodiments, the RNA comprises at least one poly(N) sequence, e.g. at least one poly(A) sequence, at least one poly(U) sequence, at least one poly(C) sequence, or combinations thereof.

In preferred embodiments, the RNA of the invention comprises at least one poly(A) sequence.

The terms "poly(A) sequence", "poly(A) tail" or "3'-poly (A) tail" as used herein will be recognized and understood by the person of ordinary skill in the art, and are e.g. intended to be a sequence of adenosine nucleotides, typically located at the 3'-end of a linear RNA (or in a circular RNA), of up to about 1000 adenosine nucleotides. Preferably, said poly(A) sequence is essentially homopolymeric, e.g. a poly(A) sequence of e.g. 100 adenosine nucleotides has essentially the length of 100 nucleotides. In other embodiments, the poly(A) sequence is interrupted by at least one nucleotide different from an adenosine nucleotide, e.g. a poly(A) sequence of e.g. 100 adenosine nucleotides may have a length of more than 100 nucleotides (comprising 100 adenosine nucleotides and in addition said at least one nucleotide—or a stretch of nucleotides—different from an adenosine nucleotide).

The poly(A) sequence may comprise about 10 to about 500 adenosine nucleotides, about 10 to about 200 adenosine nucleotides, about 40 to about 200 adenosine nucleotides, or about 40 to about 150 adenosine nucleotides. Suitably, the length of the poly(A) sequence may be at least about or even more than about 10, 50, 64, 75, 100, 200, 300, 400, or 500 adenosine nucleotides. In certain embodiments the RNA comprises at least one poly(A) sequence comprising 30 to 200 adenosine nucleotides, wherein the 3' terminal nucleotide of said RNA is an adenosine.

In preferred embodiments, the RNA of the invention comprises at least one poly(A) sequence comprising about 30 to about 200 adenosine nucleotides. In particularly preferred embodiments, the poly(A) sequence comprises about 64 adenosine nucleotides (A64). In particularly preferred embodiments, the poly(A) sequence comprises about 100 adenosine nucleotides (A100). In other embodiments, the poly(A) sequence comprises about 150 adenosine nucleotides.

In further embodiments, the RNA of the invention comprises at least one poly(A) sequence comprising about 100 adenosine nucleotides, wherein the poly(A) sequence is interrupted by non-adenosine nucleotides, preferably by 10 non-adenosine nucleotides (A30-N10-A70).

The poly(A) sequence as defined herein may be located directly at the 3' terminus of the RNA, preferably directly at the 3' terminus of an RNA.

In preferred embodiments, the 3'-terminal nucleotide (that is the last 3'-terminal nucleotide in the polynucleotide chain) is the 3'-terminal A nucleotide of the at least one poly(A) sequence. The term "directly located at the 3' terminus" has to be understood as being located exactly at the 3' terminus—in other words, the 3' terminus of the nucleic acid consists of a poly(A) sequence terminating with an A nucleotide.

It has been shown by the inventors that this embodiment is particularly beneficial for induction an immune response against SARS-CoV-2. In this context, it was shown that already one vaccination was sufficient to result in virus-neutralizing antibody titers.

In a particularly preferred embodiment, the RNA sequence comprises a poly(A) sequence of at least 70 adenosine nucleotides, wherein the 3'-terminal nucleotide is an adenosine nucleotide.

In this context it has been shown that ending on an adenosine nucleotide decreases the induction of IFNalpha by the RNA vaccine. This is particularly important as the induction of IFNalpha is thought to be the main factor for induction of fever in vaccinated subjects, which of course has to be avoided.

In preferred embodiments, the poly(A) sequence of the RNA is obtained from a DNA template during RNA in vitro transcription. In other embodiments, the poly(A) sequence is obtained in vitro by common methods of chemical synthesis without being necessarily transcribed from a DNA template. In other embodiments, poly(A) sequences are generated by enzymatic polyadenylation of the RNA (after RNA in vitro transcription) using commercially available polyadenylation kits and corresponding protocols known in the art, or alternatively, by using immobilized poly(A)polymerases e.g. using a methods and means as described in WO2016/174271, the entire contents of which are hereby incorporated by reference.

In some embodiments, the RNA comprises a poly(A) sequence obtained by enzymatic polyadenylation, wherein the majority of RNA molecules comprise about 100 (+/−20) to about 500 (+/−50), preferably about 250 (+/−20) adenosine nucleotides.

In other embodiments, the RNA comprises a poly(A) sequence derived from a template DNA and at least one additional poly(A) sequence generated by enzymatic polyadenylation, e.g. as described in WO2016/091391, the entire contents of which are hereby incorporated by reference.

In further embodiments, the RNA comprises at least one poly(C) sequence.

The term “poly(C) sequence” as used herein is intended to be a sequence of cytosine nucleotides of up to about 200 cytosine nucleotides. In preferred embodiments, the poly(C) sequence comprises about 10 to about 200 cytosine nucleotides, about 10 to about 100 cytosine nucleotides, about 20 to about 70 cytosine nucleotides, about 20 to about 60 cytosine nucleotides, or about 10 to about 40 cytosine nucleotides. In a particularly preferred embodiment, the poly(C) sequence comprises about 30 cytosine nucleotides.

In preferred embodiments, the RNA of the invention comprises at least one histone stem-loop (hSL).

The term “histone stem-loop” (abbreviated as “hSL” in e.g. the sequence listing) is intended to refer to a nucleic acid sequences that form a stem-loop secondary structure predominantly found in histone mRNAs.

Histone stem-loop sequences/structures may suitably be selected from histone stem-loop sequences as disclosed in WO2012/019780, the entire contents of which are hereby incorporated by reference, the disclosure relating to histone stem-loop sequences/histone stem-loop structures incorporated herewith by reference. A histone stem-loop sequence that may be used within the present invention may preferably be derived from formulae (I) or (II) of WO2012/019780. According to a further preferred embodiment, the RNA comprises at least one histone stem-loop sequence derived from at least one of the specific formulae (Ia) or (IIa) of the patent application WO2012/019780.

In preferred embodiments, the RNA of the invention comprises at least one histone stem-loop, wherein said histone stem-loop (hSL) comprises or consists a nucleic acid sequence identical or at least 70%, 80%, 90%, 91%, 92%, 93%, 94%, 95%, 96%, 97%, 98%, or 99% identical to SEQ ID NOs: 178 or 179, or fragments or variants thereof.

In other embodiments, the RNA does not comprise a histone stem-loop as defined herein.

In various embodiments, the RNA comprises a 3'-terminal sequence element. Said 3'-terminal sequence element comprises a poly(A) sequence and optionally a histone-stem-loop sequence. Accordingly, the RNA of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 254, 22893, 22903, 26997, 26999, 28529, 28531, 28533, 28535, 28537, 28539 or a fragment or variant thereof.

In preferred embodiments, the RNA comprises a 3'-terminal sequence element. Said 3'-terminal sequence element comprises a poly(A) sequence. Accordingly, the nucleic acid of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 254, 22903, 26999, 28531, 28525, 28539 or a fragment or variant thereof.

In preferred embodiments, the RNA comprises a 3'-terminal sequence element. Said 3'-terminal sequence element comprises a poly(A) sequence and a histone-stem-loop sequence. Accordingly, the nucleic acid of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 254, 22893, 26997, 28529, 28533, 28537 or a fragment or variant thereof.

In various embodiments, the RNA may comprise a 5'-terminal sequence element according to SEQ ID NOs: 176, 177 or 22840-22844, or a fragment or variant thereof.

In further embodiments, the RNA may comprise a 5'-terminal sequence element according to SEQ ID NOs: 176, 177 or 22840-22844 or a fragment or variant thereof. Such a 5'-terminal sequence element comprises e.g. a binding site for T7 RNA polymerase. Further, the first nucleotide of said 5'-terminal start sequence may preferably comprise a 2'O methylation, e.g. 2'O methylated guanosine or a 2'O methylated adenosine.

In preferred embodiments, the comprises at least one heterologous 5'-UTR that comprises or consists of a nucleic acid sequence derived from a 5'-UTR from HSD17B4 and at least one heterologous 3'-UTR comprises or consists of a nucleic acid sequence derived from a 3'-UTR of PSMB3. In certain embodiments, the 5'-UTR from HSD17B4 is at least about 95%, 96%, 97%, 98% to 99% identical to SEQ ID NO: 232. In some embodiments, the 3'-UTR of PSMB3 is at least about 95%, 96%, 97%, 98% to 99% identical to SEQ ID NO: 254. In especially preferred embodiments the RNA comprises, from 5' to 3': i) 5'-cap1 structure; ii) 5'-UTR derived from a 5'-UTR of a HSD17B4 gene, preferably according to SEQ ID NO: 232; iii) the at least one coding sequence (encoding a SARS-CoV Spike antigen of the embodiments); iv) 3'-UTR derived from a 3'-UTR of a PSMB3 gene, preferably according to SEQ ID NO: 254; v) optionally, a histone stem-loop sequence; and vi) poly(A) sequence comprising about 100 A nucleotides, wherein the 3' terminal nucleotide of said RNA is an adenosine.

Preferably, the RNA comprises about 50 to about 20000 nucleotides, or about 500 to about 10000 nucleotides, or about 1000 to about 10000 nucleotides, or preferably about 1000 to about 5000 nucleotides, or even more preferably about 2000 to about 5000 nucleotides.

According to particularly preferred embodiments, the RNA is a coding RNA. In preferred embodiments, the coding RNA may be selected from an mRNA, a (coding) self-replicating RNA, a (coding) circular RNA, a (coding) viral RNA, or a (coding) replicon RNA.

In other embodiments, the coding RNA is a circular RNA. As used herein, “circular RNA” or “circRNAs” have to be understood as a circular polynucleotide constructs that encode at least one antigenic peptide or protein as defined herein. Preferably, such a circRNA is a single stranded RNA molecule. In preferred embodiments, said circRNA comprises at least one coding sequence encoding at least one antigenic protein from a SARS-CoV-2 coronavirus, or an immunogenic fragment or an immunogenic variant thereof.

In further embodiments, the coding RNA is a replicon RNA. The term “replicon RNA” will be recognized and understood by the person of ordinary skill in the art, and is e.g. intended to be an optimized self-replicating RNA. Such constructs may include replicase elements derived from e.g. alphaviruses (e.g. SFV, SIN, VEE, or RRV) and the substitution of the structural virus proteins with the nucleic acid of interest (that is, the coding sequence encoding an antigenic peptide or protein of a SARS-CoV-2 coronavirus). Alternatively, the replicase may be provided on an independent coding RNA construct or a coding DNA construct. Downstream of the replicase may be a sub-genomic promoter that controls replication of the replicon RNA.

In particularly preferred embodiments, the at least one nucleic acid is not a replicon RNA or a self-replicating RNA.

In particularly preferred embodiments, the RNA of the invention is an mRNA.

Preferably, the mRNA does not comprise a replicase element (e.g. a nucleic acid encoding a replicase).

The terms "RNA" and "mRNA" will be recognized and understood by the person of ordinary skill in the art, and are e.g. intended to be a ribonucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. The mRNA (messenger RNA) provides the nucleotide coding sequence that may be translated into an amino-acid sequence of a particular peptide or protein.

In the context of the invention, the RNA, preferably the mRNA, provides at least one coding sequence encoding an antigenic protein from a SARS-CoV-2 spike protein as defined herein that is translated into a (functional) antigen after administration (e.g. after administration to a subject, e.g. a human subject).

In preferred embodiments, the RNA, preferably the mRNA is suitable for a SARS-CoV-2 vaccine, preferably a SARS-CoV-2 vaccine against at least one of the following SARS-CoV-2 isolates: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

In particularly preferred embodiments, the RNA, preferably the mRNA is suitable for a SARS-CoV-2 vaccine, preferably a SARS-CoV-2 vaccine against B.1.351 (South Africa) or B.1.1.529 (Omicron, South Africa) (including BA.1_v1, BA.1_v0, B.1.1.529, BA.2, BA.1_v2, BA.1_v3, BA.1_v4, BA.1_v5).

Suitably, the RNA may be modified by the addition of a 5'-cap structure, which preferably stabilizes the RNA and/or enhances expression of the encoded antigen and/or reduces the stimulation of the innate immune system (after administration to a subject). A 5'-cap structure is of particular importance in embodiments where the RNA is a linear coding RNA, e.g. a linear mRNA or a linear coding replicon RNA.

Accordingly, in preferred embodiments, the RNA, in particular the mRNA comprises a 5'-cap structure, preferably cap0, cap1, cap2, a modified cap0, or a modified cap1 structure.

The term "5'-cap structure" as used herein will be recognized and understood by the person of ordinary skill in the art, and is e.g. intended to refer to a 5' modified nucleotide, particularly a guanine nucleotide, positioned at the 5'-end of an RNA, e.g. an mRNA. Preferably, the 5'-cap structure is connected via a 5'-5'-triphosphate linkage to the RNA.

5'-cap structures which may be suitable in the context of the present invention are cap0 (methylation of the first nucleobase, e.g. m7GpppN), cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-cap (cap0 or cap1) structure may be formed in chemical RNA synthesis or in RNA in vitro transcription (co-transcriptional capping) using cap analogues.

The term "cap analogue" as used herein will be recognized and understood by the person of ordinary skill in the art, and is e.g. intended to refer to a non-polymerizable di-nucleotide or tri-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5'-terminus because it does not have a 5' triphosphate and therefore cannot be extended in the 3'-direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g. GpppG); dimethylated cap analogue (e.g. m2,7GpppG), trimethylated cap analogue (e.g. m2,2,7GpppG), dimethylated symmetrical cap analogues (e.g. m7Gpppm7G), or anti reverse cap analogues (e.g. ARCA; m7,2'OmeGpppG, m7,2'dGpppG, m7,3'OmeGpppG, m7,3'dGpppG and their tetraphosphate derivatives). Further cap analogues have been described previously (WO2008/016473, WO2008/157688, WO2009/149253, WO2011/015347, and WO2013/059475). Further suitable cap analogues in that context are described in WO2017/066793, WO2017/066781, WO2017/066791, WO2017/066789, WO2017/053297, WO2017/066782, WO2018/075827 and WO2017/066797 wherein the disclosures referring to cap analogues are incorporated herewith by reference.

In some embodiments, a modified cap1 structure is generated using tri-nucleotide cap analogue as disclosed in WO2017/053297, WO2017/066793, WO2017/066781, WO2017/066791, WO2017/066789, WO2017/066782, WO2018/075827 and WO2017/066797, the entire contents of the aforementioned PCT applications are hereby incorporated by reference. In particular, any cap structures derivable from the structure disclosed in claim 1-5 of WO2017/053297 may be suitably used to co-transcriptionally generate a modified cap1 structure. Further, any cap structures derivable from the structure defined in claim 1 or claim 21 of WO2018/075827 may be suitably used to co-transcriptionally generate a modified cap1 structure.

In preferred embodiments, the RNA, in particular the mRNA comprises a cap1 structure.

In preferred embodiments, the 5'-cap structure may suitably be added co-transcriptionally using tri-nucleotide cap analogue as defined herein in an RNA in vitro transcription reaction as defined herein.

In preferred embodiments, the cap1 structure of the coding RNA of the invention is formed using co-transcriptional capping using tri-nucleotide cap analogues m7G(5')ppp(5')(2'OMeA)pG or m7G(5')ppp(5')(2'OMeG)pG. A preferred cap1 analogues in that context is m7G(5')ppp(5')(2'OMeA)pG.

In other preferred embodiments, the cap1 structure of the RNA of the invention is formed using co-transcriptional capping using tri-nucleotide cap analogue 3'OMe-m7G(5')ppp(5')(2'OMeA)pG.

In other embodiments, a cap0 structure of the RNA of the invention is formed using co-transcriptional capping using cap analogue 3'OMe-m7G(5')ppp(5')G.

In other embodiments, the 5'-cap structure is formed via enzymatic capping using capping enzymes (e.g. vaccinia virus capping enzymes and/or cap-dependent 2'-0 methyltransferases) to generate cap0 or cap1 or cap2 structures. The 5'-cap structure (cap0 or cap1) may be added using immobilized capping enzymes and/or cap-dependent 2'-0 methyltransferases using methods and means disclosed in WO2016/193226, the entire content of which is hereby incorporated by reference.

In preferred embodiments, about 70%, 75%, 80%, 85%, 90%, 95% of the RNA (species) comprises a cap1 structure as determined using a capping assay. In preferred embodiments, less than about 20%, 15%, 10%, 5%, 4%, 3%, 2%, 1% of the RNA (species) does not comprise a cap1 structure as determined using a capping assay. In other preferred embodiments, about 70%, 75%, 80%, 85%, 90%, 95% of the RNA (species) comprises a cap0 structure as determined using a capping assay. In preferred embodiments, less than about 20%, 15%, 10%, 5%, 4%, 3%, 2%, 1% of the RNA (species) does not comprise a cap0 structure as determined using a capping assay.

The term "RNA species" is not restricted to mean "one single molecule" but is understood to comprise an ensemble of essentially identical RNA molecules. Accordingly, it may relate to a plurality of essentially identical (coding) RNA molecules.

For determining the presence/absence of a cap0 or a cap1 structure, a capping assay as described in published PCT application WO2015/101416, the entire content of which is hereby incorporated by reference; in particular, as described in claims 27 to 46 of published PCT application WO2015/101416 can be used. Other capping assays that may be used to determine the presence/absence of a cap0 or a cap1 structure of an RNA are described in PCT/EP2018/08667, or published PCT applications WO2014/152673 and WO2014/152659, the entire content of the aforementioned PCT applications are hereby incorporated by reference.

In preferred embodiments, the RNA comprises an m7G(5')ppp(5')(2'OMeA) cap structure. In such embodiments, the coding RNA comprises a 5'-terminal m7G cap, and an additional methylation of the ribose of the adjacent nucleotide of m7GpppN, in that case, a 2'O methylated Adenosine. Preferably, about 70%, 75%, 80%, 85%, 90%, 95% of the RNA (species) comprises such a cap1 structure as determined using a capping assay.

In other preferred embodiments, the RNA comprises an m7G(5')ppp(5')(2'OMeG) cap structure. In such embodiments, the coding RNA comprises a 5'-terminal m7G cap, and an additional methylation of the ribose of the adjacent nucleotide, in that case, a 2'O methylated guanosine. Preferably, about 70%, 75%, 80%, 85%, 90%, 95% of the coding RNA (species) comprises such a cap1 structure as determined using a capping assay.

Accordingly, the first nucleotide of said RNA or mRNA sequence, that is, the nucleotide downstream of the m7G(5')ppp structure, may be a 2'O methylated guanosine or a 2'O methylated adenosine.

According to some embodiments, the RNA is a modified RNA, wherein the modification refers to chemical modifications comprising backbone modifications as well as sugar modifications or base modifications.

A modified RNA may comprise nucleotide analogues/modifications, e.g. backbone modifications, sugar modifications or base modifications. A backbone modification in the context of the invention is a modification, in which phosphates of the backbone of the nucleotides of the RNA are chemically modified. A sugar modification in the context of the invention is a chemical modification of the sugar of the nucleotides of the RNA. Furthermore, a base modification in the context of the invention is a chemical modification of the base moiety of the nucleotides of the RNA. In this context, nucleotide analogues or modifications are preferably selected from nucleotide analogues which are applicable for transcription and/or translation.

In particularly preferred embodiments, the nucleotide analogues/modifications which may be incorporated into a modified RNA as described herein are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-lodo-2'-deoxycytidine-5'-triphosphate, 5-iodouridine-5'-triphosphate, 5-lodo-2'-deoxyuridine-5-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, 5'-O-(1-thiophosphate)-adenosine, 5'-O-(1-thiophosphate)-cytidine, 5'-O-(1-thiophosphate)-guanosine, 5'-O-(1-thiophosphate)-uridine, 5'-O-(1-thiophosphate)-pseudouridine, 6-aza-cytidine, 2-thio-cytidine, alpha-thio-cytidine, Pseudo-iso-cytidine, 5-aminoallyl-uridine, 5-iodo-uridine, N1-methyl-pseudouridine, 5,6-dihydrouridine, alpha-thio-uridine, 4-thio-uridine, 6-aza-uridine, 5-hydroxy-uridine, deoxy-thymidine, 5-methyl-uridine, Pyrrolo-cytidine, inosine, alpha-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, alpha-thio-adenosine, 8-azido-adenosine, 7-deazaadenosine.

In some embodiments, the at least one modified nucleotide is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

In some embodiments, 100% of the uracil in the coding sequence as defined herein have a chemical modification, preferably a chemical modification is in the 5-position of the uracil.

Particularly preferred in the context of the invention are pseudouridine N1-methylpseudouridine (m1ψ), 5-methylcytosine, and 5-methoxyuridine.

In some embodiments, however, the RNA of the invention does not include any N1-methylpseudouridine (m1ψ)) substituted positions. In further aspects, the RNA of the embodiments does not include any pseudouridine N1-methylpseudouridine (m1ψ), 5-methylcytosine, and 5-methoxyuridine substituted position. In still further embodiments, the RNA of the invention comprises a coding sequence that consists only of G, C, A and U nucleotides.

Incorporating modified nucleotides such as pseudouridine (ψ), N1-methylpseudouridine (m1ψ), 5-methylcytosine, and/or 5-methoxyuridine into the coding sequence of the RNA may be advantageous as unwanted innate immune responses (upon administration of the coding RNA or the vaccine) may be adjusted or reduced (if required).

In some embodiments, the RNA comprises at least one coding sequence encoding a SARS-CoV-2 antigenic protein as defined herein, wherein said coding sequence comprises at least one modified nucleotide selected from pseudouridine (ψ) and N1-methylpseudouridine (m1ψ), preferably wherein all uracil nucleotides are replaced by pseudouridine (ψ) nucleotides and/or N1-methylpseudouridine (m1ψ) nucleotides.

In preferred embodiments, the RNA does not comprise N1-methylpseudouridine (m1ψ) substituted positions. In further embodiments, the RNA does not comprise pseudouridine (ψ), N1-methylpseudouridine (m1ψ), 5-methylcytosine, and 5-methoxyuridine substituted position.

In preferred embodiments, the RNA comprises a coding sequence that consists only of G, C, A and U nucleotides and therefore does not comprise modified nucleotides (except of the 5' terminal cap structure, e.g. cap1)

Nucleic Acid, Preferably mRNA Constructs Suitable for a Coronavirus Vaccine:

In various embodiments the RNA, preferably the mRNA comprises, preferably in 5'- to 3'-direction, the following elements:

A) 5'-cap structure, preferably as specified herein;
B) 5'-terminal start element, preferably as specified herein;
C) optionally, a 5'-UTR, preferably as specified herein;
D) a ribosome binding site, preferably as specified herein;
E) at least one coding sequence, preferably as specified herein;
F) 3'-UTR, preferably as specified herein;
G) optionally, poly(A) sequence, preferably as specified herein;
H) optionally, poly(C) sequence, preferably as specified herein;
I) optionally, histone stem-loop preferably as specified herein;
J) optionally, 3'-terminal sequence element, preferably as specified herein.

In particularly preferred embodiments the nucleic acid, preferably the mRNA, comprises the following elements in 5'-to 3'-direction:

A) cap1 structure as defined herein;
B) 5'-UTR derived from a HSD17B4 gene as defined herein, preferably according to SEQ ID NOs: 231 or 232;
C) coding sequence selected from SEQ ID NOs: 116, 136, 137, 146, 22765, 22767, 22769, 22771, 22773, 22775, 22777, 22779, 22781, 22783, 22785, 23089-23148, 23150-23184, 27110-27247, 28589-28637, 28916, 28921-28924 or fragments or variants thereof;

D) 3'-UTR derived from a 3'-UTR of a PSMB3 gene as defined herein, preferably according to SEQ ID NOs: 253 or 254;

E) a histone stem-loop selected from SEQ ID NOs: 178 or 179;

F) poly(A) sequence comprising about 100 A nucleotides, preferably representing the 3' terminus.

In further preferred embodiments the nucleic acid, preferably the mRNA, comprises the following elements in 5'- to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 116, 136, 137, 146, 22765, 22767, 22769, 22771, 22773, 22775, 22777, 22779, 22781, 22783, 22785, 23089-23148, 23150-23184, 27110-27247, 28589-28637, 28916, 28921-28924 or fragments or variants thereof;

D) 3'-UTR derived from a 3'-UTR of a PSMB3 gene as defined herein, preferably according to SEQ ID NOs: 253 or 254;

F) poly(A) sequence comprising about 100 A nucleotides, preferably representing the 3' terminus.

In particularly preferred embodiments the nucleic acid, preferably the mRNA, comprises the following elements in 5'-to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 27118, 27141, 27164, 27187, 27210, 27233, 28601-28606 or fragments or variants thereof;

D) 3'-UTR derived from a 3'-UTR of a PSMB3 gene as defined herein, preferably according to SEQ ID NOs: 253 or 254;

E) a histone stem-loop selected from SEQ ID NOs: 178 or 179;

F) poly(A) sequence comprising about 100 A nucleotides, preferably representing the 3' terminus.

In further preferred embodiments the nucleic acid, preferably the mRNA, comprises the following elements in 5'- to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 27118, 27141, 27164, 27187, 27210, 27233, 28601-28606 or fragments or variants thereof;

D) 3'-UTR derived from a 3'-UTR of a PSMB3 gene as defined herein, preferably according to SEQ ID NOs: 253 or 254;

F) poly(A) sequence comprising about 100 A nucleotides, preferably representing the 3' terminus.

In particularly preferred embodiments the nucleic acid, preferably the mRNA, comprises the following elements in 5'-to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 27118, 27141, 27164, 27187, 27210, 27233 or fragments or variants thereof;

D) 3'-UTR derived from a 3'-UTR of a PSMB3 gene as defined herein, preferably according to SEQ ID NOs: 253 or 254;

E) a histone stem-loop selected from SEQ ID NOs: 178 or 179;

F) poly(A) sequence comprising about 100 A nucleotides, preferably representing the 3' terminus.

In further preferred embodiments the nucleic acid, preferably the mRNA, comprises the following elements in 5'- to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 27118, 27141, 27164, 27187, 27210, 27233 or fragments or variants thereof;

D) 3'-UTR derived from a 3'-UTR of a PSMB3 gene as defined herein, preferably according to SEQ ID NOs: 253 or 254;

F) poly(A) sequence comprising about 100 A nucleotides, preferably representing the 3' terminus.

In particularly preferred embodiments the nucleic acid, preferably the mRNA, comprises the following elements in 5'-to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 28590-28593, 28921-28924 or fragments or variants thereof;

D) 3'-UTR derived from a 3'-UTR of a PSMB3 gene as defined herein, preferably according to SEQ ID NOs: 253 or 254;

E) a histone stem-loop selected from SEQ ID NOs: 178 or 179;

F) poly(A) sequence comprising about 100 A nucleotides, preferably representing the 3' terminus.

In further preferred embodiments the nucleic acid, preferably the mRNA, comprises the following elements in 5'- to 3'-direction:

A) cap1 structure as defined herein;

B) 5'-UTR derived from a HSD17B4 gene as defined herein, preferably according to SEQ ID NOs: 231 or 232;

C) coding sequence selected from SEQ ID NOs: 28590-28593, 28921-28924 or fragments or variants thereof;

D) 3'-UTR derived from a 3'-UTR of a PSMB3 gene as defined herein, preferably according to SEQ ID NOs: 253 or 254;

F) poly(A) sequence comprising about 100 A nucleotides, preferably representing the 3' terminus.

Preferred RNA sequences, preferably mRNA sequences of the invention are provided in Table 2. Therein, each row represents a specific suitable SARS-CoV-2 construct of the invention, wherein the description of the SARS-CoV-2 backbone construct is indicated in column A (Col A) of Table 2 and the corresponding RNA sequences, in particular mRNA sequences comprising preferred coding sequences are provided in columns C-G (Col. C-G). Table 2a, provides RNA sequences with HSD17B4/PSMB3-hSL-A100 (a-1). Table 2b with HSD17B4/PSMB3-A100 (a-1).

TABLE 2a

Nucleic acid, preferably mRNA constructs suitable for a vaccine

| Col A | Col B | Col C | Col D | Col E | Col F | Col G |
|---|---|---|---|---|---|---|
| S_stab_PP(K986P_V987P_D614G) | 22792, 28737 | 23536 | 23554 | 23572 | 23590 | 23608 |
| S_stab_PP(K986P_V987P_A222V_D614G) | 22794, 28738 | 23537 | 23555 | 23573 | 23591 | 23609 |
| S_stab_PP(K986P_V987P_N439K_D614G) | 22796, 28739 | 23538 | 23556 | 23574 | 23592 | 23610 |
| S_stab_PP(K986P_V987P_S477N_D614G) | 22798, 28740 | 23539 | 23557 | 23575 | 23593 | 23611 |
| S_stab_PP(K986P_V987P_N501Y_D614G) | 22800, 28741 | 23540 | 23558 | 23576 | 23594 | 23612 |
| S_stab_PP(K986P_V987P_H69del_V70del_D614G) | 22802, 28742 | 23541 | 23559 | 23577 | 23595 | 23613 |
| S_stab_PP(K986P_V987P_Y453F_D614G) | 22804, 28743 | 23542 | 23560 | 23578 | 23596 | 23614 |
| S_stab_PP(K986P_V987P_D614G_LI692V) | 22806, 28744 | 23543 | 23561 | 23579 | 23597 | 23615 |
| S_stab_PP(K986P_V987P_D614G_M1229I) | 22808, 28745 | 23544 | 23562 | 23580 | 23598 | 23616 |
| S_stab_PP(K986P_V987P_H69del_V70del_A222V_Y453F_S477N_D614G_I692V) | 22810, 28746 | 23545 | 23563 | 23581 | 23599 | 23617 |
| S_stab_PP(K986P_V987P_H69del_V70del_Y453F_D614G_I692V_M1229I) | 22812, 28747 | 23546 | 23564 | 23582 | 23600 | 23618 |
| S_stab_PP(K986P_V987P_H69del_V70del_Y144del_N501Y_A570D_D614G_P681H_T716I_S982A_D1118H) | 23529, 28748 | 23547 | 23565 | 23583 | 23601 | 23619 |
| S_stab_PP(K986P_V987P_K417N_E484K_N501Y_D614G) | 23530, 28749 | 23548 | 23566 | 23584 | 23602 | 23620 |
| S_stab_PP(K986P_V987P_L18F_D80A_D215G_L242del_A243del_L244del_R246I_K417N_E484K_N501Y_D614G_A701V) | 23531, 28750 | 23549 | 23567 | 23585 | 23603 | 23621 |
| S_stab_PP(K986P_V987P_E484K_D614G) | 23532, 28751 | 23550 | 23568 | 23586 | 23604 | 23622 |
| S_stab_PP(K986P_V987P_L18F_T20N_P26S_D138Y_R190S_K417T_E484K_N501Y_D614G_H655Y_T1027I) | 23533, 28752 | 23551 | 23569 | 23587 | 23605 | 23623 |
| S_stab_PP(K986P_V987P_S13I_W152C_L452R_D614G) | 23534, 28753 | 23552 | 23570 | 23588 | 23606 | 23624 |
| S_stab_PP(K986P_V987P_H69del_V70del_Y144del_E484K_N501Y_A570D_D614G_P681H_T716I_S982A_D1118H) | 27386, 28754 | 27409 | 27432 | 27455 | 27478 | 27501 |
| S_stab_PP(K986P_V987P_L18F_D80A_D215G_L242del_A243del_L244del_K417N_E484K_N501Y_D614G_A701V) | 27387, 28755 | 27410 | 27433 | 27456 | 27479 | 27502 |
| S_stab_PP(K986P_V987P_Q52R_A67V_H69del_V70del_Y144del_E484K_D614G_Q677H_F888L) | 27388, 28756 | 27411 | 27434 | 27457 | 27480 | 27503 |
| S_stab_PP(K986P_V987P_A67V_H69del_V70del_Y144del_E484K_D614G_Q677H_F888L) | 27389, 28757 | 27412 | 27435 | 27458 | 27481 | 27504 |
| S_stab_PP(K986P_V987P_L18F_T20N_P26S_D138Y_R190S_K417T_E484K_N501Y_D614G_H655Y_T1027I_V1176F) | 27390, 28758 | 27413 | 27436 | 27459 | 27482 | 27505 |
| S_stab_PP(K986P_V987P_E484K_D614G_V1176F) | 27391, 28759 | 27414 | 27437 | 27460 | 27483 | 27506 |
| S_stab_PP(K986P_V987P_L452R_D614G_P681R) | 27392, 28760 | 27415 | 27438 | 27461 | 27484 | 27507 |
| S_stab_PP(K986P_V987P_E154K_L452R_E484Q_D614G_P681R_Q1071H) | 27393, 28761 | 27416 | 27439 | 27462 | 27485 | 27508 |
| S_stab_PP(K986P_V987P_T19R_F157del_R158del_L452R_T478K_D614G_P681R_D950N) | 27394, 28762 | 27417 | 27440 | 27463 | 27486 | 27509 |
| S_stab_PP(K986P_V987P_G75V_T76I_R246del_S247del_Y248del_L249del_T250del_P251del_G252del_L452Q_F490S_D614G_T859N) | 27395, 28763 | 27418 | 27441 | 27464 | 27487 | 27510 |
| S_stab_PP(K986P_V987P_H69del_V70del_N439K_D614G) | 27396, 28764 | 27419 | 27442 | 27465 | 27488 | 27511 |
| S_stab_PP(K986P_V987P_L5F_T95I_D253G_E484K_D614G_A701V) | 27397, 28765 | 27420 | 27443 | 27466 | 27489 | 27512 |
| S_stab_PP(K986P_V987P_L5F_T95I_D253G_S477N_D614G_Q957R) | 27398, 28766 | 27421 | 27444 | 27467 | 27490 | 27513 |
| S_stab_PP(K986P_V987P_F157L_V367F_Q613H_P681R) | 27399, 28767 | 27422 | 27445 | 27468 | 27491 | 27514 |
| S_stab_PP(K986P_V987P_S254F_D614G_P681R_G769V) | 27400, 28768 | 27423 | 27446 | 27469 | 27492 | 27515 |
| S_stab_PP(K986P_V987P_P26S_H69del_V70del_V126A_Y144del_L242del_A243del_L244del_H245Y_S477N_E484K_D614G_P681H_T1027I_D1118H) | 27401, 28769 | 27424 | 27447 | 27470 | 27493 | 27516 |
| S_stab_PP(K986P_V987P_T95I_Y144T_Y145S_ins145N_R346K_E484K_N501Y_D614G_P681H_D950N) | 27402, 28770 | 27425 | 27448 | 27471 | 27494 | 27517 |

TABLE 2a-continued

Nucleic acid, preferably mRNA constructs suitable for a vaccine

| Col A | Col B | Col C | Col D | Col E | Col F | Col G |
|---|---|---|---|---|---|---|
| S_stab_PP(K986P_V987P_ins214TDR_Q414K_N450K_D614G_T716I) | 27403, 28771 | 27426 | 27449 | 27472 | 27495 | 27518 |
| S_stab_PP(K986P_V987P_T478K_D614G_P681H_T732A) | 27404, 28772 | 27427 | 27450 | 27473 | 27496 | 27519 |
| S_stab_PP(K986P_V987P_E484K_N501Y_D614G_P681H_E1092K_H1101Y_V1176F) | 27405, 28773 | 27428 | 27451 | 27474 | 27497 | 27520 |
| S_stab_PP(K986P_V987P_H66D_G142V_Y144del_Y145del_D215G_V483A_D614G_H655Y_G669S_Q949R_N1187D) | 27406, 28774 | 27429 | 27452 | 27475 | 27498 | 27521 |
| S_stab_PP(K986P_V987P_Y144del_L452R_T478K_P681R) | 27407, 28775 | 27430 | 27453 | 27476 | 27499 | 27522 |
| S_stab_PP(K986P_V987P_T19R_Y144del_Y145del_L452R_T478K_D614G_P681R) | 27408, 28776 | 27431 | 27454 | 27477 | 27500 | 27523 |
| S_stab_PP(K986P_V987P_P9L_C136F_Y144del_R190S_D215G_L242del_A243del_Y449H_E484K_N501Y_D614G_H655Y_N679K_T716I_T859N) | 28638, 28777 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v1) | 28639, 28778 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_K417N_N440K_G446S_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v0) | 28640, 28779 | | | | | |
| S_stab_PP(K986P_V987P_A67V_T95I_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_B.1.1.529) | 28641, 28780 | | | | | |
| S_stab_PP(K986P_V987P_T19I_L24del_P25del_P26del_A27S_G142D_V213G_G339D_S371F_S373P_S375F_T376A_D405N_S477N_T478K_E484A_Q493R_Q498R_N501Y_Y505H_D614G_H655Y_N679K_P681H_D796Y_Q954H_N969K); S_stab_PP(K986P_V987P_BA.2) | 28642, 28781 | | | | | |
| S_stab_PP(K986P_V987P_G75V_T76I_R246del_S247del_Y248del_L249del_T250del_P251del_G252del_D253N_L452Q_F490S_D614G_T859N) | 28643, 28782 | | | | | |
| S_stab_PP(K986P_V987P_T95I_Y144S_Y145N_R346K_E484K_N501Y_D614G_P681H_D950N) | 28644, 28783 | | | | | |
| S_stab_PP(K986P_V987P_S12F_H69del_V70del_W152R_R346S_L452R_D614G_Q677H_A899S) | 28645, 28784 | | | | | |
| S_stab_PP(K986P_V987P_I210T_N440K_E484K_D614G_D936N_S939F_T1027I) | 28646, 28785 | | | | | |
| S_stab_PP(K986P_V987P_W152L_E484K_D614G_G769V) | 28647, 28786 | | | | | |
| S_stab_PP(K986P_V987P_T20I_R357K_D614G) | 28648, 28787 | | | | | |
| S_stab_PP(K986P_V987P_T95I_Y144del_E484K_D614G_P681H_D796H) | 28649, 28788 | | | | | |
| S_stab_PP(K986P_V987P_T19R_G142D_E156G_F157del_R158del_L452R_T478K_D614G_P681R_D950N) | 28650, 28789 | | | | | |
| S_stab_PP(K986P_V987P_T19R_T95I_G142D_E156G_F157del_R158del_W258L_K417N_L452R_T478K_D614G_P681R_D950N) | 28651, 28790 | | | | | |
| S_stab_PP(K986P_V987P_T19R_V70F_G142D_E156G_F157del_R158del_A222V_K417N_L452R_T478K_D614G_P681R_D950N) | 28652, 28791 | | | | | |
| S_stab_PP(K986P_V987P_T19R_T95I_G142D_E156G_F157del_R158del_L452R_T478K_D614G_P681R_D950N) | 28653, 28792 | | | | | |
| S_stab_PP(K986P_V987P_T19R_E156G_F157del_R158del_L452R_T478K_D614G_P681R_D950N) | 28654, 28793 | | | | | |
| S_stab_PP(K986P_V987P_T19R_T95I_G142D_Y145H_E156G_F157del_R158del_A222V_L452R_T478K_D614G_P681R_D950N) | 28655, 28794 | | | | | |

TABLE 2a-continued

Nucleic acid, preferably mRNA constructs suitable for a vaccine

| Col A | Col B | Col C | Col D | Col E | Col F | Col G |
|---|---|---|---|---|---|---|
| S_stab_PP(K986P_V987P_T19R_L452R_E484Q_D614G_P681R_D950N) | 28656, 28795 | | | | | |
| S_stab_PP(K986P_V987P_L452R_D614G_P681R_R682del_R683del_A684del_R685del) | 28657, 28796 | | | | | |
| S_stab_PP(K986P_V987P_E154K_L452R_E484Q_D614G_P681R_R682del_R683del_A684del_R685del_Q1071H) | 28658, 28797 | | | | | |
| S_stab_PP(K986P_V987P_T19R_F157del_R158del_L452R_T478K_D614G_P681R_R682del_R683del_A684del_R685del_D950N) | 28659, 28798 | | | | | |
| S_stab_PP(K986P_V987P_T19R_G142D_E156G_F157del_R158del_L452R_T478K_D614G_P681R_R682del_R683del_A684del_R685del_D950N) | 28660, 28799 | | | | | |
| S_stab_PP(K986P_V987P_T19R_T95I_G142D_E156G_F157del_R158del_W258L_K417N_L452R_T478K_D614G_P681R_R682del_R683del_A684del_R685del_D950N) | 28661, 28800 | | | | | |
| S_stab_PP(K986P_V987P_T19R_V70F_G142D_E156G_F157del_R158del_A222V_K417N_L452R_T478K_D614G_P681R_R682del_R683del_A684del_R685del_D950N) | 28662, 28801 | | | | | |
| S_stab_PP(K986P_V987P_T19R_T95I_G142D_E156G_F157del_R158del_L452R_T478K_D614G_P681R_R682del_R683del_A684del_R685del_D950N) | 28663, 28802 | | | | | |
| S_stab_PP(K986P_V987P_T19R_E156G_F157del_R158del_L452R_T478K_D614G_P681R_R682del_R683del_A684del_R685del_D950N) | 28664, 28803 | | | | | |
| S_stab_PP(K986P_V987P_T19R_T95I_G142D_Y145H_E156G_F157del_R158del_A222V_L452R_T478K_D614G_P681R_R682del_R683del_A684del_R685del_D950N) | 28665, 28804 | | | | | |
| S_stab_PP(K986P_V987P_T19R_L452R_E484Q_D614G_P681R_R682del_R683del_A684del_R685del_D950N) | 28666, 28805 | | | | | |
| S_stab_PP(K986P_V987P_L452R_E484K_D614G_P681R) | 28667, 28806 | | | | | |
| S_stab_PP(K986P_V987P_E154K_L452R_E484K_D614G_P681R_Q1071H) | 28668, 28807 | | | | | |
| S_stab_PP(K986P_V987P_T19R_F157del_R158del_L452R_T478K_E484K_D614G_P681R_D950N) | 28669, 28808 | | | | | |
| S_stab_PP(K986P_V987P_T19R_G142D_E156G_F157del_R158del_L452R_T478K_E484K_D614G_P681R_D950N) | 28670, 28809 | | | | | |
| S_stab_PP(K986P_V987P_T19R_T95I_G142D_E156G_F157del_R158del_W258L_K417N_L452R_T478K_E484K_D614G_P681R_D950N) | 28671, 28810 | | | | | |
| S_stab_PP(K986P_V987P_T19R_V70F_G142D_E156G_F157del_R158del_A222V_K417N_L452R_T478K_E484K_D614G_P681R_D950N) | 28672, 28811 | | | | | |
| S_stab_PP(K986P_V987P_T19R_T95I_G142D_E156G_F157del_R158del_L452R_T478K_E484K_D614G_P681R_D950N) | 28673, 28812 | | | | | |
| S_stab_PP(K986P_V987P_T19R_E156G_F157del_R158del_L452R_T478K_E484K_D614G_P681R_D950N) | 28674, 28813 | | | | | |
| S_stab_PP(K986P_V987P_T19R_T95I_G142D_Y145H_E156G_F157del_R158del_A222V_L452R_T478K_E484K_D614G_P681R_D950N) | 28675, 28814 | | | | | |
| S_stab_PP(K986P_V987P_T19R_L452R_E484K_D614G_P681R_D950N) | 28676, 28815 | | | | | |
| S_stab_PP(K986P_V987P_L452R_E484K_D614G_P681R_R682del_R683del_A684del_R685del) | 28677, 28816 | | | | | |
| S_stab_PP(K986P_V987P_E154K_L452R_E484K_D614G_P681R_R682del_R683del_A684del_R685del_Q1071H) | 28678, 28817 | | | | | |
| S_stab_PP(K986P_V987P_T19R_F157del_R158del_L452R_T478K_E484K_D614G_P681R_R682del_R683del_A684del_R685del_D950N) | 28679, 28818 | | | | | |
| S_stab_PP(K986P_V987P_T19R_G142D_E156G_F157del_R158del_L452R_T478K_E484K_D614G_P681R_R682del_R683del_A684del_R685del_D950N) | 28680, 28819 | | | | | |
| S_stab_PP(K986P_V987P_T19R_T95I_G142D_E156G_F157del_R158del_W258L_K417N_L452R_T478K_E484K_D614G_P681R_R682del_R683del_A684del_R685del_D950N) | 28681, 28820 | | | | | |

TABLE 2a-continued

Nucleic acid, preferably mRNA constructs suitable for a vaccine

| Col A | Col B | Col C | Col D | Col E | Col F | Col G |
|---|---|---|---|---|---|---|
| S_stab_PP(K986P_V987P_T19R_V70F_G142D_E156G_F157del_R158del_A222V_K417N_L452R_T478K_E484K_D614G_P681R_R682del_R683del_A684del_R685del_D950N) | 28682, 28821 | | | | | |
| S_stab_PP(K986P_V987P_T19R_T95I_G142D_E156G_F157del_R158del_L452R_T478K_E484K_D614G_P681R_R682del_R683del_A684del_R685del_D950N) | 28683, 28822 | | | | | |
| S_stab_PP(K986P_V987P_T19R_E156G_F157del_R158del_L452R_T478K_E484K_D614G_P681R_R682del_R683del_A684del_R685del_D950N) | 28684, 28823 | | | | | |
| S_stab_PP(K986P_V987P_T19R_T95I_G142D_Y145H_E156G_F157del_R158del_A222V_L452R_T478K_E484K_D614G_P681R_R682del_R683del_A684del_R685del_D950N) | 28685, 28824 | | | | | |
| S_stab_PP(K986P_V987P_T19R_L452R_E484K_D614G_P681R_R682del_R683del_A684del_R685del_D950N) | 28686, 28825 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_N440K_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v2) | 28925, 28933 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_BA.1_v3) | 28926, 28934 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_A701V_N764K_D796Y_N856K_Q954H_N969K_L981F); S_stab_PP(K986P_V987P_BA.1_v4) | 28927, 28935 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_G446S_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v5) | 28928, 28936 | | | | | |

TABLE 2b

Nucleic acid, preferably mRNA constructs suitable for a coronavirus vaccine

| Col A | Col B | Col C | Col D | Col E | Col F | Col G |
|---|---|---|---|---|---|---|
| S_stab_PP(K986P_V987P_D614G) | 24838, 28827 | 24856 | 24874 | 24892 | 24910 | 24928 |
| S_stab_PP(K986P_V987P_A222V_D614G) | 24839, 28828 | 24857 | 24875 | 24893 | 24911 | 24929 |
| S_stab_PP(K986P_V987P_N439K_D614G) | 24840, 28829 | 24858 | 24876 | 24894 | 24912 | 24930 |
| S_stab_PP(K986P_V987P_S477N_D614G) | 24841, 28830 | 24859 | 24877 | 24895 | 24913 | 24931 |
| S_stab_PP(K986P_V987P_N501Y_D614G) | 24842, 28831 | 24860 | 24878 | 24896 | 24914 | 24932 |
| S_stab_PP(K986P_V987P_H69del_V70del_D614G) | 24843, 28832 | 24861 | 24879 | 24897 | 24915 | 24933 |
| S_stab_PP(K986P_V987P_Y453F_D614G) | 24844, 28833 | 24862 | 24880 | 24898 | 24916 | 24934 |
| S_stab_PP(K986P_V987P_D614G_I692V) | 24845, 28834 | 24863 | 24881 | 24899 | 24917 | 24935 |
| S_stab_PP(K986P_V987P_D614G_M1229I) | 24846, 28835 | 24864 | 24882 | 24900 | 24918 | 24936 |
| S_stab_PP(K986P_V987P_H69del_V70del_A222V_Y453F_S477N_D614G_I692V) | 24847, 28836 | 24865 | 24883 | 24901 | 24919 | 24937 |

TABLE 2b-continued

Nucleic acid, preferably mRNA constructs suitable for a coronavirus vaccine

| Col A | Col B | Col C | Col D | Col E | Col F | Col G |
|---|---|---|---|---|---|---|
| S_stab_PP(K986P_V987P_H69del_V70del_Y453F_D614G_I692V_M1229I) | 24848, 28837 | 24866 | 24884 | 24902 | 24920 | 24938 |
| S_stab_PP(K986P_V987P_H69del_V70del_Y144del_N501Y_A570D_D614G_P681H_T716I_S982A_D1118H) | 24849, 28838 | 24867 | 24885 | 24903 | 24921 | 24939 |
| S_stab_PP(K986P_V987P_K417N_E484K_N501Y_D614G) | 24850, 28839 | 24868 | 24886 | 24904 | 24922 | 24940 |
| S_stab_PP(K986P_V987P_L18F_D80A_D215G_L242del_A243del_L244del_R246I_K417N_E484K_N501Y_D614G_A701V) | 24851, 28840 | 24869 | 24887 | 24905 | 24923 | 24941 |
| S_stab_PP(K986P_V987P_E484K_D614G) | 24852, 28841 | 24870 | 24888 | 24906 | 24924 | 24942 |
| S_stab_PP(K986P_V987P_L18F_T20N_P26S_D138Y_R190S_K417T_E484K_N501Y_D614G_H655Y_T1027I) | 24853, 28842 | 24871 | 24889 | 24907 | 24925 | 24943 |
| S_stab_PP(K986P_V987P_S13I_W152C_L452R_D614G) | 24854, 28843 | 24872 | 24890 | 24908 | 24926 | 24944 |
| S_stab_PP(K986P_V987P_H69del_V70del_Y144del_E484K_N501Y_A570D_D614G_P681H_T716I_S982A_D1118H) | 27524, 28844 | 27547 | 27570 | 27593 | 27616 | 27639 |
| S_stab_PP(K986P_V987P_L18F_D80A_D215G_L242del_A243del_L244del_K417N_E484K_N501Y_D614G_A701V) | 27525, 28845 | 27548 | 27571 | 27594 | 27617 | 27640 |
| S_stab_PP(K986P_V987P_Q52R_A67V_H69del_V70del_Y144del_E484K_D614G_Q677H_F888L) | 27526, 28846 | 27549 | 27572 | 27595 | 27618 | 27641 |
| S_stab_PP(K986P_V987P_A67V_H69del_V70del_Y144del_E484K_D614G_Q677H_F888L) | 27527, 28847 | 27550 | 27573 | 27596 | 27619 | 27642 |
| S_stab_PP(K986P_V987P_L18F_T20N_P26S_D138Y_R190S_K417T_E484K_N501Y_D614G_H655Y_T1027I_V1176F) | 27528, 28848 | 27551 | 27574 | 27597 | 27620 | 27643 |
| S_stab_PP(K986P_V987P_E484K_D614G_V1176F) | 27529, 28849 | 27552 | 27575 | 27598 | 27621 | 27644 |
| S_stab_PP(K986P_V987P_L452R_D614G_P681R) | 27530, 28850 | 27553 | 27576 | 27599 | 27622 | 27645 |
| S_stab_PP(K986P_V987P_E154K_L452R_E484Q_D614G_P681R_Q1071H) | 27531, 28851 | 27554 | 27577 | 27600 | 27623 | 27646 |
| S_stab_PP(K986P_V987P_T19R_F157del_R158del_L452R_T478K_D614G_P681R_D950N) | 27532, 28852 | 27555 | 27578 | 27601 | 27624 | 27647 |
| S_stab_PP(K986P_V987P_G75V_T76I_R246del_S247del_Y248del_L249del_T250del_P251del_G252del_L452Q_F490S_D614G_T859N) | 27533, 28853 | 27556 | 27579 | 27602 | 27625 | 27648 |
| S_stab_PP(K986P_V987P_H69del_V70del_N439K_D614G) | 27534, 28854 | 27557 | 27580 | 27603 | 27626 | 27649 |
| S_stab_PP(K986P_V987P_L5F_T95I_D253G_E484K_D614G_A701V) | 27535, 28855 | 27558 | 27581 | 27604 | 27627 | 27650 |
| S_stab_PP(K986P_V987P_L5F_T95I_D253G_S477N_D614G_Q957R) | 27536, 28856 | 27559 | 27582 | 27605 | 27628 | 27651 |
| S_stab_PP(K986P_V987P_F157L_V367F_Q613H_P681R) | 27537, 28857 | 27560 | 27583 | 27606 | 27629 | 27652 |
| S_stab_PP(K986P_V987P_S254F_D614G_P681R_G769V) | 27538, 28858 | 27561 | 27584 | 27607 | 27630 | 27653 |
| S_stab_PP(K986P_V987P_P26S_H69del_V70del_V126A_Y144del_L242del_A243del_L244del_H245Y_S477N_E484K_D614G_P681H_T1027I_D1118H) | 27539, 28859 | 27562 | 27585 | 27608 | 27631 | 27654 |
| S_stab_PP(K986P_V987P_T95I_Y144T_Y145S_ins145N_R346K_E484K_N501Y_D614G_P681H_D950N) | 27540, 28860 | 27563 | 27586 | 27609 | 27632 | 27655 |
| S_stab_PP(K986P_V987P_ins214TDR_Q414K_N450K_D614G_T716I) | 27541, 28861 | 27564 | 27587 | 27610 | 27633 | 27656 |
| S_stab_PP(K986P_V987P_T478K_D614G_P681H_T732A) | 27542, 28862 | 27565 | 27588 | 27611 | 27634 | 27657 |
| S_stab_PP(K986P_V987P_E484K_N501Y_D614G_P681H_E1092K_H1101Y_V1176F) | 27543, 28863 | 27566 | 27589 | 27612 | 27635 | 27658 |
| S_stab_PP(K986P_V987P_H66D_G142V_Y144del_Y145del_D215G_V483A_D614G_H655Y_G669S_Q949R_N1187D) | 27544, 28864 | 27567 | 27590 | 27613 | 27636 | 27659 |
| S_stab_PP(K986P_V987P_Y144del_L452R_T478K_P681R) | 27545, 28865 | 27568 | 27591 | 27614 | 27637 | 27660 |
| S_stab_PP(K986P_V987P_T19R_Y144del_Y145del_L452R_T478K_D614G_P681R) | 27546, 28866 | 27569 | 27592 | 27615 | 27638 | 27661 |
| S_stab_PP(K986P_V987P_P9L_C136F_Y144del_R190S_D215G_L242del_A243del_Y449H_E484K_N501Y_D614G_H655Y_N679K_T716I_T859N) | 28687, 28867 | | | | | |
| SS_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v1) | 28688, 28868 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_K417N_N440K_G446S_S477N_T478K_E484A_Q493R_G496S_Q498R_N501Y_ | 28689, 28869 | | | | | |

TABLE 2b-continued

| Nucleic acid, preferably mRNA constructs suitable for a coronavirus vaccine | | | | | | |
|---|---|---|---|---|---|---|
| Col A | Col B | Col C | Col D | Col E | Col F | Col G |
| Y505H_T547K_D614G_H655Y_N679K_P681H_N764K_D796Y_N856K_Q954H_N969K_L981F); S_stab_PP(K986P_V987P_BA.1_v0) | | | | | | |
| S_stab_PP(K986P_V987P_A67V_T95I_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_B.1.1.529) | 28690, 28870 | | | | | |
| S_stab_PP(K986P_V987P_T19I_L24del_P25del_P26del_A27S_G142D_V213G_G339D_S371F_S373P_S375F_T376A_D405N_S477N_T478K_E484A_Q493R_Q498R_N501Y_Y505H_D614G_H655Y_N679K_P681H_D796Y_Q954H_N969K); S_stab_PP(K986P_V987P_BA.2) | 28691, 28871 | | | | | |
| S_stab_PP(K986P_V987P_G75V_T76I_R246del_S247del_Y248del_L249del_T250del_P251del_G252del_D253N_L452Q_F490S_D614G_T859N) | 28692, 28872 | | | | | |
| S_stab_PP(K986P_V987P_T95I_Y144S_Y145N_R346K_E484K_N501Y_D614G_P681H_D950N) | 28693, 28873 | | | | | |
| S_stab_PP(K986P_V987P_S12F_H69del_V70del_W152R_R346S_L452R_D614G_Q677H_A899S) | 28694, 28874 | | | | | |
| S_stab_PP(K986P_V987P_I210T_N440K_E484K_D614G_D936N_S939F_T1027I) | 28695, 28875 | | | | | |
| S_stab_PP(K986P_V987P_W152L_E484K_D614G_G769V) | 28696, 28876 | | | | | |
| S_stab_PP(K986P_V987P_T20I_R357K_D614G) | 28697, 28877 | | | | | |
| S_stab_PP(K986P_V987P_T95I_Y144del_E484K_D614G_P681H_D796H) | 28698, 28878 | | | | | |
| S_stab_PP(K986P_V987P_T19R_G142D_E156G_F157del_R158del_L452R_T478K_D614G_P681R_D950N) | 28699, 28879 | | | | | |
| S_stab_PP(K986P_V987P_T19R_T95I_G142D_E156G_F157del_R158del_W258L_K417N_L452R_T478K_D614G_P681R_D950N) | 28700, 28880 | | | | | |
| S_stab_PP(K986P_V987P_T19R_V70F_G142D_E156G_F157del_R158del_A222V_K417N_L452R_T478K_D614G_P681R_D950N) | 28701, 28881 | | | | | |
| S_stab_PP(K986P_V987P_T19R_T95I_G142D_E156G_F157del_R158del_L452R_T478K_D614G_P681R_D950N) | 28702, 28882 | | | | | |
| S_stab_PP(K986P_V987P_T19R_E156G_F157del_R158del_L452R_T478K_D614G_P681R_D950N) | 28703, 28883 | | | | | |
| S_stab_PP(K986P_V987P_T19R_T95I_G142D_Y145H_E156G_F157del_R158del_A222V_L452R_T478K_D614G_P681R_D950N) | 28704, 28884 | | | | | |
| S_stab_PP(K986P_V987P_T19R_L452R_E484Q_D614G_P681R_D950N) | 28705, 28885 | | | | | |
| S_stab_PP(K986P_V987P_L452R_D614G_P681R_R682del_R683del_A684del_R685del) | 28706, 28886 | | | | | |
| S_stab_PP(K986P_V987P_E154K_L452R_E484Q_D614G_P681R_R682del_R683del_A684del_R685del_Q1071H) | 28707, 28887 | | | | | |
| S_stab_PP(K986P_V987P_T19R_F157del_R158del_L452R_T478K_D614G_P681R_R682del_R683del_A684del_R685del_D950N) | 28708, 28888 | | | | | |
| S_stab_PP(K986P_V987P_T19R_G142D_E156G_F157del_R158del_L452R_T478K_D614G_P681R_R682del_R683del_A684del_R685del_D950N) | 28709, 28889 | | | | | |
| S_stab_PP(K986P_V987P_T19R_T95I_G142D_E156G_F157del_R158del_W258L_K417N_L452R_T478K_D614G_P681R_R682del_R683del_A684del_R685del_D950N) | 28710, 28890 | | | | | |
| S_stab_PP(K986P_V987P_T19R_V70F_G142D_E156G_F157del_R158del_A222V_K417N_L452R_T478K_D614G_P681R_R682del_R683del_A684del_R685del_D950N) | 28711, 28891 | | | | | |
| S_stab_PP(K986P_V987P_T19R_T95I_G142D_E156G_F157del_R158del_L452R_T478K_D614G_P681R_R682del_R683del_A684del_R685del_D950N) | 28712, 28892 | | | | | |
| S_stab_PP(K986P_V987P_T19R_E156G_F157del_R158del_L452R_T478K_D614G_P681R_R682del_R683del_A684del_R685del_D950N) | 28713, 28893 | | | | | |
| S_stab_PP(K986P_V987P_T19R_T95I_G142D_Y145H_E156G_F157del_R158del_A222V_L452R_T478K_D614G_P681R_R682del_R683del_A684del_R685del_D950N) | 28714, 28894 | | | | | |
| S_stab_PP(K986P_V987P_T19R_L452R_E484Q_D614G_P681R_R682del_R683del_A684del_R685del_D950N) | 28715, 28895 | | | | | |
| S_stab_PP(K986P_V987P_L452R_E484K_D614G_P681R) | 28716, 28896 | | | | | |
| S_stab_PP(K986P_V987P_E154K_L452R_E484K_D614G_P681R_Q1071H) | 28717, 28897 | | | | | |

TABLE 2b-continued

| Nucleic acid, preferably mRNA constructs suitable for a coronavirus vaccine | | | | | | |
|---|---|---|---|---|---|---|
| Col A | Col B | Col C | Col D | Col E | Col F | Col G |
| S_stab_PP(K986P_V987P_T19R_F157del_R158del_L452R_T478K_E484K_D614G_P681R_D950N) | 28718, 28898 | | | | | |
| S_stab_PP(K986P_V987P_T19R_G142D_E156G_F157del_R158del_L452R_T478K_E484K_D614G_P681R_D950N) | 28719, 28899 | | | | | |
| S_stab_PP(K986P_V987P_T19R_T95I_G142D_E156G_F157del_R158del_W258L_K417N_L452R_T478K_E484K_D614G_P681R_D950N) | 28720, 28900 | | | | | |
| S_stab_PP(K986P_V987P_T19R_V70F_G142D_E156G_F157del_R158del_A222V_K417N_L452R_T478K_E484K_D614G_P681R_D950N) | 28721, 28901 | | | | | |
| S_stab_PP(K986P_V987P_T19R_T95I_G142D_E156G_F157del_R158del_L452R_T478K_E484K_D614G_P681R_D950N) | 28722, 28902 | | | | | |
| S_stab_PP(K986P_V987P_T19R_E156G_F157del_R158del_L452R_T478K_E484K_D614G_P681R_D950N) | 28723, 28903 | | | | | |
| S_stab_PP(K986P_V987P_T19R_T95I_G142D_Y145H_E156G_F157del_R158del_A222V_L452R_T478K_E484K_D614G_P681R_D950N) | 28724, 28904 | | | | | |
| S_stab_PP(K986P_V987P_T19R_L452R_E484K_D614G_P681R_D950N) | 28725, 28905 | | | | | |
| S_stab_PP(K986P_V987P_L452R_E484K_D614G_P681R_R682del_R683del_A684del_R685del) | 28726, 28906 | | | | | |
| S_stab_PP(K986P_V987P_E154K_L452R_E484K_D614G_P681R_R682del_R683del_A684del_R685del_Q1071H) | 28727, 28907 | | | | | |
| S_stab_PP(K986P_V987P_T19R_F157del_R158del_L452R_T478K_E484K_D614G_P681R_R682del_R683del_A684del_R685del_D950N) | 28728, 28908 | | | | | |
| S_stab_PP(K986P_V987P_T19R_G142D_E156G_F157del_R158del_L452R_T478K_E484K_D614G_P681R_R682del_R683del_A684del_R685del_D950N) | 28729, 28909 | | | | | |
| S_stab_PP(K986P_V987P_T19R_T95I_G142D_E156G_F157del_R158del_W258L_K417N_L452R_T478K_E484K_D614G_P681R_R682del_R683del_A684del_R685del_D950N) | 28730, 28910 | | | | | |
| S_stab_PP(K986P_V987P_T19R_V70F_G142D_E156G_F157del_R158del_A222V_K417N_L452R_T478K_E484K_D614G_P681R_R682del_R683del_A684del_R685del_D950N) | 28731, 28911 | | | | | |
| S_stab_PP(K986P_V987P_T19R_T95I_G142D_E156G_F157del_R158del_L452R_T478K_E484K_D614G_P681R_R682del_R683del_A684del_R685del_D950N) | 28732, 28912 | | | | | |
| S_stab_PP(K986P_V987P_T19R_E156G_F157del_R158del_L452R_T478K_E484K_D614G_P681R_R682del_R683del_A684del_R685del_D950N) | 28733, 28913 | | | | | |
| S_stab_PP(K986P_V987P_T19R_T95I_G142D_Y145H_E156G_F157del_R158del_A222V_L452R_T478K_E484K_D614G_P681R_R682del_R683del_A684del_R685del_D950N) | 28734, 28914 | | | | | |
| S_stab_PP(K986P_V987P_T19R_L452R_E484K_D614G_P681R_R682del_R683del_A684del_R685del_D950N) | 28735, 28915 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_N440K_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v2) | 28929, 28937 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_BA.1_v3) | 28930, 28938 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_N701V_N764K_D796Y_N856K_Q954H_N969K_L981F); S_stab_PP(K986P_V987P_BA.1_v4) | 28931, 28939 | | | | | |
| S_stab_PP(K986P_V987P_A67V_H69del_V70del_T95I_G142D_V143del_Y144del_Y145del_N211del_L212I_ins214EPE_G339D_S371L_S373P_S375F_G446S_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v5) | 28932, 28940 | | | | | |

In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 148, 149, 151, 162, 163, 165, 22792, 22794, 22796, 22798, 22800, 22802, 22804, 22806, 22808, 22810, 22812, 22819, 22821, 22823, 22825, 22827, 22829, 22831, 22833, 22835, 22837, 22839, 23309-23368, 23370-23404, 23529-23588, 23590-23624, 24837-24944, 27248-27907, 28638-28915, 28925-28940 or a fragment or variant of any of these sequences. In certain embodiments at least one, preferably all uracil nucleotides in said RNA sequences are replaced by pseudouridine (ψ) nucleotides and/or N1-methylpseudouridine (m1ψ) nucleotides.

In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs provided in Columns B-G of Table 2a or Table 2b or a fragment or variant of any of these sequences. In certain embodiments at least one, preferably all uracil nucleotides in said RNA sequences are replaced by pseudouridine (ψ) nucleotides and/or N1-methylpseudouridine (m1ψ) nucleotides.

In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 27256, 27279, 27302, 27325, 27348, 27371, 27394, 27417, 27440, 27463, 27486, 27509, 27532, 27555, 27578, 27601, 27624, 27647, 27688, 27729, 27770, 27811, 27852, 27893, 28650-28655, 28699-28704, 28762, 28789-28794, 28852, 28879-28884 or a fragment or variant of any of these sequences. In certain embodiments at least one, preferably all uracil nucleotides in said RNA sequences are replaced by pseudouridine (ψ) nucleotides and/or N1-methylpseudouridine (m1ψ) nucleotides.

In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 27256, 27279, 27302, 27325, 27348, 27371, 27394, 27417, 27440, 27463, 27486, 27509, 27532, 27555, 27578, 27601, 27624, 27647, 27688, 27729, 27770, 27811, 27852, 27893, 28762, 28852 or a fragment or variant of any of these sequences. In certain embodiments at least one, preferably all uracil nucleotides in said RNA sequences are replaced by pseudouridine (ψ) nucleotides and/or N1-methylpseudouridine (m1ψ) nucleotides.

In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 28639-28642, 28778-28781, 28688-28691, 28868-28871, 28925-28940 or a fragment or variant of any of these sequences. In certain embodiments at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-28686, 28777-28825, 28925-28928, 28933-28936 or a fragment or variant of any of these sequences. Further information regarding respective nucleic acid sequences is provided under <223> identifier of the respective SEQ ID NO in the sequence listing, and in Table 2 (see in particular Column B-G).

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27394, 27417, 27486, 28762, 28650-28655, 28789-28794 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27394, 27417, 27486, 28762 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 28639-28642, 28778-28781, 28925-28928, 28933-28936 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 24837-24854, 27524-27546, 24855-24872, 27547-27569, 24909-24926, 27616-27638, 28827-28866, 28687-28735, 28867-28915, 28929-28932, 28937-28940 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27532, 27555, 27624, 28852, 28699-28704, 28879-28884 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27532, 27555, 27624, 28852 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 28688-28691, 28868-28871, 28929-28932, 28937-28940 or a fragment or variant of any of these sequences.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-

28686, 28777-28825, 28925-28928, 28933-28936 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27394, 27417, 27486, 28762, 28650-28655, 28789-28794 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27394, 27417, 27486, 28762 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 28639-28642, 28778-28781, 28925-28928, 28933-28936 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 24837-24854, 27524-27546, 24855-24872, 27547-27569, 24909-24926, 27616-27638, 28827-28866, 28687-28735, 28867-28915, 28929-28932, 28937-28940 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27532, 27555, 27624, 28852, 28699-28704, 28879-28884 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 27532, 27555, 27624, 28852 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In preferred embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 28688-28691, 28868-28871, 28929-28932, 28937-28940 or a fragment or variant of any of these sequences, wherein at least one, preferably all uracil nucleotides in said RNA sequences are replaced by pseudouridine (ψ) nucleotides and/or N1-methylpseudouridine (m1ψ) nucleotides.

In particular embodiments, the RNA of the invention may be prepared using any method known in the art, including chemical synthesis such as e.g. solid phase RNA synthesis, as well as in vitro methods, such as RNA in vitro transcription reactions. Accordingly, in a preferred embodiment, the RNA is obtained by RNA in vitro transcription.

Accordingly, in preferred embodiments, the RNA of the invention is preferably an in vitro transcribed RNA.

The terms "RNA in vitro transcription" or "in vitro transcription" relate to a process wherein RNA is synthesized in a cell-free system (in vitro). RNA may be obtained by DNA-dependent in vitro transcription of an appropriate DNA template, which according to the present invention is a linearized plasmid DNA template or a PCR-amplified DNA template. The promoter for controlling RNA in vitro transcription can be any promoter for any DNA-dependent RNA polymerase. Particular examples of DNA-dependent RNA polymerases are the T7, T3, SP6, or Syn5 RNA polymerases. In a preferred embodiment of the present invention the DNA template is linearized with a suitable restriction enzyme, before it is subjected to RNA in vitro transcription.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (T7, T3, SP6, or Syn5); ribonucleotide triphosphates (NTPs) for the four bases (adenine, cytosine, guanine and uracil); optionally, a cap analogue as defined herein; optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any potentially contaminating RNase; optionally, a pyrophosphatase to degrade pyrophosphate, which may inhibit RNA in vitro transcription; MgCl2, which supplies Mg2+ ions as a co-factor for the polymerase; a buffer (TRIS or HEPES) to maintain a suitable pH value, which can also contain antioxidants (e.g. DTT), and/or polyamines such as spermidine at optimal concentrations, e.g. a buffer system comprising TRIS-Citrate as disclosed in WO2017/109161.

In preferred embodiments, the cap1 structure of the RNA of the invention is formed using co-transcriptional capping using tri-nucleotide cap analogues m7G(5')ppp(5')(2'OMeA)pG or m7G(5')ppp(5')(2'OMeG)pG. A preferred cap1 analogue that may suitably be used in manufacturing the coding RNA of the invention is m7G(5')ppp(5')(2'OMeA)pG.

In a particularly preferred embodiment, the cap1 structure of the RNA of the invention is formed using co-transcriptional capping using tri-nucleotide cap analogue 3'OMe-m7G(5')ppp(5')(2'OMeA)pG.

In other embodiments, a capO structure of the RNA of the invention is formed using co-transcriptional capping using cap analogue 3'OMe-m7G(5')ppp(5')G.

In additional embodiments, the nucleotide mixture used in RNA in vitro transcription may additionally comprise modified nucleotides as defined herein. In that context, preferred modified nucleotides may be selected from pseudouridine (ψ), N1-methylpseudouridine (m1ψ), 5-methylcytosine, and 5-methoxyuridine. In particular embodiments, uracil nucleotides in the nucleotide mixture are replaced (either partially or completely) by pseudouridine (ψ) and/or N1-methylpseudouridine (m1ψ) to obtain a modified RNA.

In preferred embodiments, the nucleotide mixture used in RNA in vitro transcription does not comprise modified nucleotides as defined herein. In preferred embodiments, the nucleotide mixture used in RNA in vitro transcription does only comprise G, C, A and U nucleotides, and, optionally, a cap analog as defined herein.

In preferred embodiments, the nucleotide mixture (i.e. the fraction of each nucleotide in the mixture) used for RNA in vitro transcription reactions may be optimized for the given RNA sequence, preferably as described in WO2015/188933, the entire contents of which are hereby incorporated by reference.

In this context the in vitro transcription has been performed in the presence of a sequence optimized nucleotide mixture and optionally a cap analog, preferably wherein the sequence optimized nucleotide mixture does not comprise chemically modified nucleotides.

In this context a sequence-optimized nucleoside triphosphate (NTP) mix is a mixture of nucleoside triphosphates (NTPs) for use in an in vitro transcription reaction of an RNA molecule of a given sequence comprising the four nucleoside triphosphates (NTPs) GTP, ATP, CTP and UTP, wherein the fraction of each of the four nucleoside triphosphates (NTPs) in the sequence-optimized nucleoside triphosphate (NTP) mix corresponds to the fraction of the respective nucleotide in said RNA molecule. If a ribonucleotide is not present in the RNA molecule, the corresponding nucleoside triphosphate is also not present in the sequence-optimized nucleoside triphosphate (NTP) mix.

In embodiments where more than one different RNA as defined herein have to be produced, e.g. where 2, 3, 4, 5, 6, 7, 8, 9, 10 or even more different RNAs have to be produced (see second aspect), procedures as described in WO2017/109134 may suitably be used.

In the context of RNA-based vaccine production, it may be required to provide GMP-grade nucleic acids, e.g. a GMP grade RNA. GMP-grade RNA may be produced using a manufacturing process approved by regulatory authorities. Accordingly, in a particularly preferred embodiment, RNA production is performed under current good manufacturing practice (GMP), implementing various quality control steps on DNA (template) and RNA level, preferably according to WO2016/180430. In preferred embodiments, the RNA of the invention is a GMP-grade RNA, particularly a GMP-grade mRNA. Accordingly, an RNA for a vaccine is preferably a GMP grade RNA.

The obtained RNA products are preferably purified using PureMessenger® (CureVac, Tübingen, Germany; RP-HPLC according to WO2008/077592) and/or tangential flow filtration (as described in WO2016/193206) and/or oligo d(T) purification (see WO2016/180430).

In a further preferred embodiment, the RNA is lyophilized (e.g. according to WO2016/165831 or WO2011/069586, the entire content of both PCT applications are hereby incorporated by reference) to yield a temperature stable dried RNA (powder). The RNA may also be dried using spray-drying or spray-freeze drying (e.g. according to WO2016/184575 or WO2016/184576) to yield a temperature stable RNA (powder) as defined herein. Accordingly, in the context of manufacturing and purifying nucleic acid, in particular RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in preferred embodiments, the RNA is a dried RNA.

The term "dried RNA" as used herein has to be understood as RNA that has been lyophilized, or spray-dried, or spray-freeze dried as defined above to obtain a temperature stable dried RNA (powder).

In preferred embodiments, the nucleic acid of the invention is a purified nucleic acid, particularly a purified RNA.

The term "purified nucleic acid" as used herein should be understood as nucleic acid which has a higher purity after certain purification steps than the starting material. Typical impurities that are essentially not present in purified nucleic acid comprise peptides or proteins, spermidine, BSA, abortive nucleic acid sequences, nucleic acid fragments, free nucleotides, bacterial impurities, or impurities derived from purification procedures. Accordingly, it is desirable in this regard for the "degree of nucleic acid purity" to be as close as possible to 100%. It is also desirable for the degree of nucleic acid purity that the amount of full-length nucleic acid is as close as possible to 100%. Accordingly, "purified nucleic acid" as used herein has a degree of purity of more than 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target nucleic acid and the total area of all peaks representing the by-products. Alternatively, the degree of purity may for example be determined by an analytical agarose gel electrophoresis or capillary gel electrophoresis.

In preferred embodiments, the nucleic acid of the invention is a purified RNA.

The term "purified RNA" or "purified mRNA" as used herein should be understood as RNA which has a higher purity after certain purification steps (e.g. HPLC, TFF, Oligo d(T) purification, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, pyrophosphatase, restriction endonuclease, DNase), spermidine, BSA, abortive RNA sequences, RNA fragments (short double stranded RNA fragments, abortive sequences etc.), free nucleotides (modified nucleotides, conventional NTPs, cap analogue), template DNA fragments, buffer components (HEPES, TRIS, MgCl2) etc. Other potential impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full-length RNA transcripts is as close as possible to 100%. Accordingly, "purified RNA" as used herein has a degree of purity of more than 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

In particularly preferred embodiments, the RNA has been purified by RP-HPLC and/or TFF to remove double-stranded RNA, non-capped RNA and/or RNA fragments.

The formation of double stranded RNA as side products during e.g. RNA in vitro transcription can lead to an induction of the innate immune response, particularly IFNalpha which is the main factor of inducing fever in vaccinated subjects, which is of course an unwanted side effect. Current techniques for immunoblotting of dsRNA (via dot Blot, serological specific electron microscopy (SSEM) or ELISA for example) are used for detecting and sizing dsRNA species from a mixture of nucleic acids.

Suitably, the RNA of the invention has been purified by RP-HPLC and/or TFF as described herein to reduce the amount of dsRNA.

Preferably, the RNA according to the invention is purified using RP-HPLC, preferably using Reversed-Phase High pressure liquid chromatography (RP-HPLC) with a macroporous styrene/divinylbenzene column (e.g. particle size 30 μm, pore size 4000 Å and additionally using a filter cassette with a cellulose-based membrane with a molecular weight cutoff of about 100 kDa.

In this context it is particularly preferred that the purified RNA has been purified by RP-HPLC and/or TFF which results in about 5%, 10%, or 20% less double stranded RNA side products as in RNA that has not been purified with RP-HPLC and/or TFF. Accordingly, the RNA of the invention comprises about 5%, 10%, or 20% less double stranded RNA side products as an RNA that has not been purified with RP-HPLC and/or TFF.

Alternatively, the purified RNA that has been purified by RP-HPLC and/or TFF comprises about 5%, 10%, or 20% less double stranded RNA side products as an RNA that has been purified with Oligo dT purification, precipitation, filtration and/or anion exchange chromatography. Accordingly, the RP-HPLC and/or TFF purified RNA of the invention comprises about 5%, 10%, or 20% less double stranded RNA side products as an RNA that has been purified with Oligo dT purification, precipitation, filtration and/or AEX.

In embodiments, an automated device for performing RNA in vitro transcription may be used to produce and purify the nucleic acid of the invention. Such a device may also be used to produce the composition or the vaccine (see aspects 2 and 3). Preferably, a device as described in WO2020/002598 (the entire content of which is hereby incorporated by reference), in particular, a device as described in claims 1 to 59 and/or 68 to 76 of WO2020/002598 (and FIGS. 1-18) may suitably be used.

The methods described herein may preferably applied to a method of producing an RNA composition or vaccine as described in further detail below.

Composition, Pharmaceutical Composition:

A second aspect relates to a composition comprising at least one RNA of the first aspect.

Notably, embodiments relating to the composition of the second aspect may likewise be read on and be understood as suitable embodiments of the vaccine of the third aspect. Also, embodiments relating to the vaccine of the third aspect may likewise be read on and be understood as suitable embodiments of the composition of the second aspect (comprising at least one RNA of the first aspect). Furthermore, features and embodiments described in the context of the first aspect (the RNA of the invention) have to be read on and have to be understood as suitable embodiments of the composition of the second aspect.

In preferred embodiments, the composition comprises at least one RNA according to the first aspect encoding at least one antigenic peptide or protein that is or is derived from a SARS-CoV-2 spike protein, or an immunogenic fragment or immunogenic variant thereof.

In preferred embodiments, the composition comprises at least one RNA encoding at least one antigenic peptide or protein that is selected or is derived from a SARS-CoV-2 spike protein, or an immunogenic fragment or immunogenic variant thereof according to the first aspect, wherein said composition is to be, preferably, administered intramuscularly or intradermal.

Preferably, intramuscular or intradermal administration of said composition results in expression of the encoded SARS-CoV-2 spike protein construct in a subject. In preferred embodiments, administration of the composition results in translation of the RNA and to a production of the encoded SARS-CoV-2 spike protein in a subject.

Preferably, the composition of the second aspect is suitable for a vaccine, in particular, suitable for a SARS-CoV-2 vaccine, preferably a SARS-CoV-2 vaccine against at least one of the following SARS-CoV-2 isolates: C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), 6.1.617.2 (Delta, India), P.2 (Zeta, Brazil), C37.1 (Lambda, Peru). P.3 (Theta, Philippines), and/or B.1.621 (Mu, Columbia).

In particularly preferred embodiments, the composition of the second aspect is suitable for a SARS-CoV-2 vaccine against B.1.351 (Beta, South Africa).

In particularly preferred embodiments, the composition of the second aspect is suitable for a SARS-CoV-2 vaccine against B.1.617.2, AY.1, AY.2, AY.4 or AY.4.2.

In particularly preferred embodiments, the composition of the second aspect is suitable for a SARS-CoV-2 vaccine against B.1.617.2.

In particularly preferred embodiments, the composition of the second aspect is suitable for a SARS-CoV-2 vaccine against B.1.1.529, B.1.1.529.1/BA.1 (Omicron) and/or B.1.1.529.2/BA.2.

In particularly preferred embodiments, the composition of the second aspect is suitable for a SARS-CoV-2 vaccine against BA.1_v1, BA.1_v0, B.1.1.529, BA.2, BA.1_v2, BA.1_v3, BA.1_v4, and/or BA.1_v5.

In particularly preferred embodiments, the composition of the second aspect is suitable for a SARS-CoV-2 vaccine against B.1.1.529 and B.1.617.2.

In the context of the invention, a "composition" refers to any type of composition in which the specified ingredients (e.g. RNA encoding at least one antigenic peptide or protein that is selected or is derived from SARS-CoV-2, e.g. in association with a lipid-based carrier) may be incorporated, optionally along with any further constituents, usually with at least one pharmaceutically acceptable carrier or excipient. The composition may be a dry composition such as a powder or granules, or a solid unit such as a lyophilized form. Alternatively, the composition may be in liquid form, and each constituent may be independently incorporated in dissolved or dispersed (e.g. suspended or emulsified) form.

In a preferred embodiment of the second aspect, the composition comprises at least one RNA of the first aspect, and optionally, at least one pharmaceutically acceptable carrier or excipient.

The term "pharmaceutically acceptable carrier" or "pharmaceutically acceptable excipient" as used herein preferably includes the liquid or non-liquid basis of the composition for administration. If the composition is provided in liquid form, the carrier may be water, e.g. pyrogen-free water; isotonic saline or buffered (aqueous) solutions, e.g. phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to preferred embodiments, the sodium, calcium and, optionally, potassium salts may occur in the form of their halogenides, e.g. chlorides, iodides, or bromides, in the form of their hydroxides, carbonates, hydrogen carbonates, or sulfates, etc. Examples of sodium salts include NaCl, NaI, NaBr, $Na_2CO_3$, $NaHCO_3$, $Na_2SO_4$, examples of the optional potassium salts include KCl, KI, KBr, $K_2CO_3$, $KHCO_3$, $K_2SO_4$, and examples of calcium salts include $CaCl_2$, $CaI_2$, $CaBr_2$, $CaCO_3$, $CaSO_4$, $Ca(OH)_2$.

Furthermore, organic anions of the aforementioned cations may be in the buffer. Accordingly, in embodiments, the nucleic acid composition may comprise pharmaceutically acceptable carriers or excipients using one or more pharmaceutically acceptable carriers or excipients to e.g. increase stability, increase cell transfection, permit the sustained or delayed, increase the translation of encoded coronavirus protein in vivo, and/or alter the release profile of encoded coronavirus protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with polynucleotides, hyaluronidase, nanoparticle mimics and combinations thereof. In embodiments, one or more compatible solid or liquid fillers or diluents or encapsulating compounds may be used as well, which are suitable for administration to a subject. The term "compatible" as used herein means that the constituents of the composition are capable of being mixed with the at least one nucleic acid and, optionally, a plurality of nucleic acids of the composition, in such a manner that no interaction occurs, which would substantially reduce the biological activity or the pharmaceutical effectiveness of the composition under typical use conditions (e.g., intramuscular or intradermal administration). Pharmaceutically acceptable carriers or excipients must have sufficiently high purity and sufficiently low toxicity to make them suitable for administration to a subject to be treated. Compounds which may be used as pharmaceutically acceptable carriers or excipients may be sugars, such as, for example, lactose, glucose, trehalose, mannose, and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The at least one pharmaceutically acceptable carrier or excipient of the composition may preferably be selected to be suitable for intramuscular or intradermal delivery/administration of said composition. Accordingly, the composition is preferably a pharmaceutical composition, suitably a composition for intramuscular administration.

Subjects to which administration of the compositions, preferably the pharmaceutical composition, is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Pharmaceutical compositions of the present invention may suitably be sterile and/or pyrogen-free.

Multivalent Compositions of the Invention:

In embodiments, the composition (e.g. multivalent composition) as defined herein may comprise a plurality or at least more than one of the RNA species as defined in the context of the first aspect of the invention. Preferably, the composition as defined herein may comprise 2, 3, 4, 5, 6, 7, 8, 9, or 10 different RNA species each defined in the context of the first aspect.

In embodiments, the composition (e.g. multivalent composition) comprises at least 2, 3, 4, 5, 6, 7, 8, 9, 10 or even more different RNA species as defined in the context of the first aspect, each encoding at least one different SARS-CoV-2 spike protein (as defined in the context of the first aspect).

In this context it is further preferred that the different SARS-CoV-2 spike proteins or prefusion stabilized spike proteins have amino acid changes in the spike protein comprising:

K986, V987P, A67V, H69del, V70del, T951, G142D, V143del, Y144del, Y145del, N211del, L2121, ins214EPE, G339D, S371L, S373P, S375F, S477N, T478K, E484A, Q493R, G496S, Q498R, N501Y, Y505H, T547K, D614G, H655Y, N679K, P681H, N764K, D796Y, N856K, Q954H, N969K, and L981F;

K986P, V987P, A67V, H69del, V70del, T951, G142D, V143del, Y144del, Y145del, N211del, L2121, ins214EPE, G339D, S371L, S373P, S375F, K417N, N440K, G446S, S477N, T478K, E484A, Q493R, G496S, Q498R, N501Y, Y505H, T547K, D614G, H655Y, N679K, P681H, N764K, D796Y, N856K, Q954H, N969K, and L981F;

K986P, V987P, A67V, T951, G339D, S371L, S373P, S375F, S477N, T478K, E484A, Q493R, G496S, Q498R, N501Y, Y505H, T547K, D614G, H655Y, N679K, P681H, D796Y, N856K, Q954H, N969K, and L981F;

K986P, V987P, T191, L24del, P25del, P26del, A27S, G142D, V213G, G339D, S371F, S373P, S375F, T376A, D405N, S477N, T478K, E484A, Q493R, Q498R, N501Y, Y505H, D614G, H655Y, N679K, P681H, D796Y, Q954H, and N969K;

K986P, V987P, A67V, H69del, V70del, T951, G142D, V143del, Y144del, Y145del, N211del, L2121, ins214EPE, G339D, S371L, S373P, S375F, N440K, S477N, T478K, E484A, Q493R, G496S, Q498R, N501Y, Y505H, T547K, D614G, H655Y, N679K, P681H, N764K, D796Y, N856K, Q954H, N969K, and L981F;

K986P, V987P, A67V, H69del, V70del, T951, G142D, V143del, Y144del, Y145del, N211del, L2121, ins214EPE, G339D, S371L, S373P, S375F, S477N, T478K, E484A, Q493R, G496S, Q498R, N501Y, Y505H, T547K, D614G, H655Y, N679K, P681H, D796Y, N856K, Q954H, N969K, and L981F;

K986P, V987P, A67V, H69del, V70del, T951, G142D, V143del, Y144del, Y145del, N211del, L2121, ins214EPE, G339D, S371L, S373P, S375F, S477N, T478K, E484A, Q493R, G496S, Q498R, N501Y, Y505H, T547K, D614G, H655Y, N679K, P681H, A701V, N764K, D796Y, N856K, Q954H, N969K, and L981F;

K986P, V987P, A67V, H69del, V70del, T951, G142D, V143del, Y144del, Y145del, N211del, L2121, ins214EPE, G339D, S371L, S373P, S375F, G446S, S477N, T478K, E484A, Q493R, G496S, Q498R, N501Y, Y505H, T547K, D614G, H655Y, N679K, P681H, N764K, D796Y, N856K, Q954H, N969K, and L981F;

E484K, N501Y, L18F, D80A, D215G, L242del, A243del, L244del, R246I, K417N, D614G, and A701V;

E484K, N501Y, L18F, D80A, D215G, L242del, A243del, L244del, K417N, D614G, and A701V;

E484K, N501Y, L18F, T20N, P26S, D138Y, R190S, K417T, D614G, H655Y, and T1027I;

E484K, N501Y, L18F, T20N, P26S, D138Y, R190S, K417T, D614G, H655Y, T1027I, and V1176F;

L452R, P681R, and D614G;

L452R, E484Q, P681R, E154K, D614G, and Q1071H; or

L452R, P681R, T19R, F157del, R158del, T478K, D614G, and D950N.

In this context it is even more preferred that the different SARS-CoV-2 spike proteins or prefusion stabilized spike proteins have amino acid changes in the spike protein comprising:

E484K, N501Y, L18F, D80A, D215G, L242del, A243del, L244del, R246I, K417N, D614G, and A701V; or E484K, N501Y, L18F, D80A, D215G, L242del, A243del, L244del, K417N, D614G, and A701V.

In this context it is even more preferred that the different SARS-CoV-2 spike proteins or prefusion stabilized spike proteins have amino acid changes in the spike protein comprising:

at least one SARS-CoV-2 spike protein or prefusion stabilized spike protein having the following amino acid changes in the spike protein:

K986P, V987P, A67V, H69del, V70del, T951, G142D, V143del, Y144del, Y145del, N211del, L2121, ins214EPE, G339D, S371L, S373P, S375F, S477N, T478K, E484A, Q493R, G496S, Q498R, N501Y, Y505H, T547K, D614G, H655Y, N679K, P681H, N764K, D796Y, N856K, Q954H, N969K, and L981F; and at least one SARS-CoV-2 spike protein or prefusion stabilized spike protein having the following amino acid changes in the spike protein:

L452R, E484Q, P681R, E154K, D614G, and Q1071H; or

L452R, P681R, T19R, F157del, R158del, T478K, D614G, and D950N.

In preferred embodiments, the composition (e.g. multivalent composition) comprises 2, 3, 4 or 5 RNA species, wherein said RNA species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-28686, 28777-28825, 28925-28928, 28933-28936 and, optionally, at least one pharmaceutically acceptable carrier or excipient, wherein each of the 2, 3, 4 or 5 nucleic acid species encode a different SARS-CoV-2 spike protein.

In preferred embodiments, the composition (e.g. multivalent composition) comprises 2, 3, 4 or 5 RNA species, wherein said RNA species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 24837-24854, 27524-27546, 24855-24872, 27547-27569, 24909-24926, 27616-27638, 28827-28866, 28687-28735, 28867-28915, 28937-28940 and, optionally, at least one pharmaceutically acceptable carrier or excipient, wherein each of the 2, 3, 4 or 5 nucleic acid species encode a different SARS-CoV-2 spike protein.

In the following, particularly preferred embodiments of a multivalent composition are provided.

In preferred embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 10, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27108-27109; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960-22961, 28540; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27093-27095, 28552-28558; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095, 28552-28558; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920.

In preferred embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27093-27095, 28552-28558, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27108-27109; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960-22961, 28540; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920.

In preferred embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095, 28552-28558, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27108-27109; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960-22961, 28540; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920.

In preferred embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27108-27109; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960-22961, 28540; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920.

In preferred embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960-22961, 28540, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27108-27109; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27093-27095, 28552-28558; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095, 28552-28558; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920.

In preferred embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27108-27109; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27093-27095, 28552-28558; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27096, 28545; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095, 28552-28558; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27095; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960-22961, 28540.

In preferred embodiments, the composition, preferably the multivalent composition is suitable for a vaccine against C.1.2 (South Africa), B.1.1.529 (Omicron, South Africa) (including BA.1_v1, BA.1_v0, B.1.1.529, BA.2, BA.1_v2, BA.1_v3, BA.1_v4, BA.1_v5), C.36.3 (Thailand), B.1.619 (Cameroon), R.1 (Kentucky, US), B.1.1.176 (Canada), AZ.3, AY.1 (India), AY.2 (India), AY.4 (India), AY.4.2 (Delta Plus, India), B.1.617.3 (India), B.1.351 (Beta, South Africa), B.1.1.7 (Alpha, UK), P.1 (Gamma, Brazil), B.1.427/B.1.429 (Epsilon, Calif., US), B.1.525 (Eta, Nigeria), B.1.258 (Czech republic), B.1.526 (Jota, N.Y., US), A.23.1 (Uganda), B.1.617.1 (Kappa, India), B.1.617.2 (Delta, India), P.2 (Zeta, Brazil), C37.1 (Lambda, Peru). P.3 (Theta, Philippines), and/or B.1.621 (Mu, Columbia).

In embodiments, the RNA as comprised in the composition is provided in an amount of about 100 ng to about 500 ug, in an amount of about 1 ug to about 200 ug, in an amount of about 1 ug to about 100 ug, in an amount of about 5 ug to about 100 ug, preferably in an amount of about 10 ug to about 50 ug, specifically, in an amount of about 1 ug, 2 ug, 3 ug, 4 ug, 5 ug, 6 ug, 7 ug, 8 ug, 9 ug, 10 ug, 11 ug, 12 ug, 13 ug, 14 ug, 15 ug, 20 ug, 25 ug, 30 ug, 35 ug, 40 ug, 45 ug, 50 ug, 55 ug, 60 ug, 65 ug, 70 ug, 75 ug, 80 ug, 85 ug, 90 ug, 95 ug or 100 ug.

In case the composition comprises a plurality or at least more than one of the RNA species as defined herein (multivalent composition), the amount of RNA for each RNA species is provided in an amount of about 100 ng to about 500 ug, in an amount of about 1 ug to about 200 ug, in an amount of about 1 ug to about 100 ug, in an amount of about 5 ug to about 100 ug, preferably in an amount of about 10 ug to about 50 ug, specifically, in an amount of about 1 ug, 2 ug, 3 ug, 4 ug, 5 ug, 6 ug, 7 ug, 8 ug, 9 ug, 10 ug, 11 ug, 12 ug, 13 ug, 14 ug, 15 ug, 20 ug, 25 ug, 30 ug, 35 ug, 40 ug, 45 ug, 50 ug, 55 ug, 60 ug, 65 ug, 70 ug, 75 ug, 80 ug, 85 ug, 90 ug, 95 ug or 100 ug.

In some embodiments, the amount of RNA for each RNA species is essentially equal in mass. In other embodiments, the amount of RNA for each RNA species is selected to be equimolar.

Complexation:

In a preferred embodiment of the second aspect, the at least one RNA, preferably the at least one mRNA, is complexed or associated with further compound to obtain a complexed formulated composition. A complexed formulation may have the function of a transfection agent. A complexed formulated composition may also have the function of protecting the RNA and/or mRNA from degradation.

In a preferred embodiment of the second aspect, the at least one RNA, preferably the at least one mRNA, and optionally the at least one further RNA, is complexed or associated with, or at least partially complexed or partially associated with one or more cationic or polycationic compound, preferably cationic or polycationic polymer, cationic or polycationic polysaccharide, cationic or polycationic lipid, cationic or polycationic protein, cationic or polycationic peptide, or any combinations thereof.

The term "cationic or polycationic compound" as used herein will be recognized and understood by the person of ordinary skill in the art, and are for example intended to refer to a charged molecule, which is positively charged at a pH value ranging from about 1 to 9, at a pH value ranging from about 3 to 8, at a pH value ranging from about 4 to 8, at a pH value ranging from about 5 to 8, more preferably at a pH value ranging from about 6 to 8, even more preferably at a pH value ranging from about 7 to 8, most preferably at a physiological pH, e.g. ranging from about 7.2 to about 7.5. Accordingly, a cationic component, e.g. a cationic peptide, cationic protein, cationic polymer, cationic polysaccharide, cationic lipid may be any positively charged compound or polymer which is positively charged under physiological conditions. A "cationic or polycationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the given conditions.

The cationic or polycationic compounds, being particularly preferred in this context may be selected from the following list of cationic or polycationic peptides or proteins of fragments thereof: protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides, pAntp, plsl, FGF, Lactoferrin, Transportan, Buforin-2, Bac715-24, SynB, SynB(1), pVEC, hCT-derived peptides, SAP, or histones. More preferably, the nucleic acid (e.g. DNA or RNA), e.g. the coding RNA, preferably the mRNA, is complexed with one or more polycations, preferably with protamine or oligofectamine, most preferably with protamine.

Further preferred cationic or polycationic compounds, which can be used as transfection or complexation agent may include cationic polysaccharides, for example chitosan, polybrene etc.; cationic lipids, e.g. DOTMA, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS, DIMRI, DOTAP, DC-6-14, CLIP1, CLIP6, CLIP9, oligofectamine; or cationic or polycationic polymers, e.g. modified polyaminoacids, such as beta-aminoacid-polymers or reversed polyamides, etc., modified polyethylenes, such as PVP etc., modified acrylates, such as pDMAEMA etc., modified amidoamines such as pAMAM etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI, poly(propyleneimine), etc., polyallylamine, sugar backbone based polymers, such as cyclodextrin based polymers, dextran based polymers, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to various embodiments, the composition of the present invention comprises at least one RNA, preferably at least one mRNA as defined in the context of the first aspect, and a polymeric carrier.

The term "polymeric carrier" as used herein will be recognized and understood by the person of ordinary skill in the art, and are e.g. intended to refer to a compound that facilitates transport and/or complexation of another compound (e.g. cargo nucleic acid). A polymeric carrier is typically a carrier that is formed of a polymer. A polymeric carrier may be associated to its cargo (e.g. DNA, or RNA) by covalent or non-covalent interaction. A polymer may be based on different subunits, such as a copolymer.

Suitable polymeric carriers in that context may include, for example, polyacrylates, polyalkycyanoacrylates, polylactide, polylactide-polyglycolide copolymers, polycaprolactones, dextran, albumin, gelatin, alginate, collagen, chitosan, cyclodextrins, protamine, PEGylated protamine, PEGylated PLL and polyethylenimine (PEI), dithiobis(succinimidylpropionate) (DSP), Dimethyl-3,3'-dithiobispropionimidate (DTBP), poly(ethylene imine) biscarbamate (PEIC), poly(L-lysine) (PLL), histidine modified PLL, poly (N-vinylpyrrolidone) (PVP), poly(propylenimine (PPI), poly(amidoamine) (PAMAM), poly(amido ethylenimine) (SS-PAEI), triehtylenetetramine (TETA), poly(β-aminoester), poly(4-hydroxy-L-proine ester) (PHP), poly(allylamine), poly(α-[4-aminobutyl]-L-glycolic acid (PAGA), Poly(D,L-lactic-co-glycolid acid (PLGA), Poly(N-ethyl-4-vinylpyridinium bromide), poly(phosphazene)s (PPZ), poly (phosphoester)s (PPE), poly(phosphoramidate)s (PPA), poly (N-2-hydroxypropylmethacrylamide) (pHPMA), poly(2-(dimethylamino)ethyl methacrylate) (pDMAEMA), poly(2-aminoethyl propylene phosphate) PPE_EA), galactosylated chitosan, N-dodecylated chitosan, histone, collagen and dextran-spermine. In one embodiment, the polymer may be an inert polymer such as, but not limited to, PEG. In one embodiment, the polymer may be a cationic polymer such as, but not limited to, PEI, PLL, TETA, poly(allylamine), Poly(N-ethyl-4-vinylpyridinium bromide), pHPMA and pDMAEMA. In one embodiment, the polymer may be a biodegradable PEI such as, but not limited to, DSP, DTBP and PEIC. In one embodiment, the polymer may be biodegradable such as, but not limited to, histine modified PLL, SS-PAEI, poly(3-aminoester), PHP, PAGA, PLGA, PPZ, PPE, PPA and PPE-EA.

Encapsulation/Complexation in LNPs:

In preferred embodiments of the second aspect, the at least one RNA, preferably the at least one mRNA, and optionally the at least one further RNA, is complexed, encapsulated, partially encapsulated, or associated with one or more lipids (e.g. cationic lipids and/or neutral lipids), thereby forming lipid-based carriers such as liposomes, lipid nanoparticles (LNPs), lipoplexes, and/or nanoliposomes.

The liposomes, lipid nanoparticles (LNPs), lipoplexes, and/or nanoliposomes—incorporated RNA may be completely or partially located in the interior space of the liposomes, lipid nanoparticles (LNPs), lipoplexes, and/or nanoliposomes, within the lipid layer/membrane, or associated with the exterior surface of the lipid layer/membrane.

The incorporation of RNA into liposomes/LNPs is also referred to herein as "encapsulation" wherein the RNA is entirely contained within the interior space of the liposomes, lipid nanoparticles (LNPs), lipoplexes, and/or nanoliposomes. The purpose of incorporating RNA into liposomes, lipid nanoparticles (LNPs), lipoplexes, and/or nanoliposomes is to protect the RNA from an environment which may contain enzymes or chemicals or conditions that degrade nucleic acid and/or systems or receptors that cause the rapid excretion of the nucleic acid. Moreover, incorporating RNA into liposomes, lipid nanoparticles (LNPs), lipoplexes, and/or nanoliposomes may promote the uptake of the RNA, and hence, may enhance the therapeutic effect of the RNA encoding antigenic SARS-CoV-2 spike proteins. Accordingly, incorporating the at least one RNA into liposomes, lipid nanoparticles (LNPs), lipoplexes, and/or nanoliposomes may be particularly suitable for a SARS-CoV-2 vaccine, e.g. for intramuscular and/or intradermal administration.

In this context, the terms "complexed" or "associated" refer to the essentially stable combination of RNA with one or more lipids into larger complexes or assemblies without covalent binding.

The term "lipid nanoparticle", also referred to as "LNP", is not restricted to any particular morphology, and include any morphology generated when a cationic lipid and optionally one or more further lipids are combined, e.g. in an aqueous environment and/or in the presence of a an RNA. For example, a liposome, a lipid complex, a lipoplex and the like are within the scope of a lipid nanoparticle (LNP).

Liposomes, lipid nanoparticles (LNPs), lipoplexes, and/or nanoliposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 nm and 500 nm in diameter.

LNPs of the invention are suitably characterized as microscopic vesicles having an interior aqua space sequestered from an outer medium by a membrane of one or more bilayers. Bilayer membranes of LNPs are typically formed by amphiphilic molecules, such as lipids of synthetic or natural origin that comprise spatially separated hydrophilic and hydrophobic domains. Bilayer membranes of the liposomes can also be formed by amphophilic polymers and surfactants (e.g., polymerosomes, niosomes, etc.). In the context of the present invention, an LNP typically serves to transport the at least one RNA to a target tissue.

Accordingly, in preferred embodiments of the second aspect, the at least one RNA is complexed with one or more lipids thereby forming lipid nanoparticles (LNP). Preferably, said LNP is particularly suitable for intramuscular and/or intradermal administration. LNPs typically comprise a cationic lipid and one or more excipients selected from neutral lipids, charged lipids, steroids and polymer conjugated lipids (e.g. PEGylated lipid). The at least one RNA may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the RNA are attached, or in which the one or more RNA species are encapsulated. Preferably, the LNP comprising RNA comprises one or more cationic lipids, and one or more stabilizing lipids. Stabilizing lipids include neutral lipids and PEGylated lipids.

Preferably, the LNP of the invention comprises (i) at least one cationic lipid;

(ii) at least one neutral lipid;

(iii) at least one steroid or steroid analogue, preferably cholesterol; and (iv) at least one polymer conjugated lipid, preferably a PEG-lipid;

wherein (i) to (iv) are in a molar ratio of about 20-60% cationic lipid, 5-25% neutral lipid, 25-55% sterol, and 0.5-15% polymer conjugated lipid.

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

Such lipids include, but are not limited to, DSDMA, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy) propyl)-N,N,N-trimethylammonium chloride (DOTMA), N,N-dimethyl-2,3-dioleyloxy)propylamine (DODMA), ckk-E12, ckk, 1,2-DiLinoleyloxy-N,N-dimethylaminopropane (DLinDMA), 1,2-Dilinolenyloxy-N,N-dimethylaminopropane (DLenDMA), 1,2-di-y-linolenyloxy-N,N-dimethylaminopropane (γ-DLenDMA), 98N12-5, 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.CI), ICE (Imidazol-based), HGT5000, HGT5001, DMDMA, CLinDMA, CpLinDMA, DMOBA, DOcarbDAP, DLincarbDAP, DLinCDAP, KLin-K-DMA, DLin-K-XTC2-DMA, XTC (2,2-Dilinoleyl-4-dimethylaminoethyl-[1,3]-dioxolane) HGT4003, 1,2-Dilinoleoyl-3-trimethylaminopropane chloride salt (DLin-TAP.CI), 1,2-Dilinoleyloxy-3-(N-methylpiperazino)propane (DLin-MPZ), or 3-(N,N-Dilinoleylamino)-1,2-propanediol (DLinAP), 3-(N, N-Dioleylamino)-1,2-propanedio (DOAP), 1,2-Dilinoleyloxo-3-(2-N,N-dimethylamino)ethoxpropane (DLin-EG-DM A), 2,2-Dilinoleyl-4-dimethylaminomethyl-[1,3]-dioxolane (DLin-K-DMA) or analogs thereof, (3aR,5s, 6aS)—N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl-4-(dimethylamino)butanoate (MC3), ALNY-100 ((3aR,5s, 6aS)—N,N-dimethyl-2,2-di((9Z,12Z)-octadeca-9,12-dienyl)tetrahydro-3aH-cyclopenta[d] [1,3]dioxol-5-amine)), 1,1'-(2-(4-(2-((2-(bis(2-hydroxydodecyl)amino)ethyl)(2-hydroxydodecyl)amino)ethyl)piperazin-1-yl)ethylazanediyl) didodecan-2-ol (C12-200), 2,2-dilinoleyl-4-(2-dimethylaminoethyl)[1,3]-dioxolane (DLin-K-C2-DMA), 2,2-dilinoleyl-4-dimethylaminomethyl-[1,3]-dioxolane (DLin-K-DMA), NC98-5 (4,7, 13-tris(3-oxo-3-(undecylamino)propyl)-N1,N 16-diundecyl-4,7, 10,13-tetraazahexadecane-1,16-diamide), (6Z,9Z,28Z,31Z)-heptatriaconta-6,9,28,31-tetraen-19-yl 4-(dimethylamino) butanoate (DLin-M-C3-DMA), 3-((6Z, 9Z,28Z,31Z)-heptatriaconta-6,9,28,31-tetraen-19-yloxy)-N, N-dimethylpropan-1-amine (MC3 Ether), 4-((6Z,9Z,28Z, 31Z)-heptatriaconta-6,9,28,31-tetraen-19-yloxy)-N,N-dimethylbutan-1-amine (MC4 Ether), LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.) or any combination of any of the foregoing. Further suitable cationic lipids for use in the compositions and methods of the invention include those described in international patent publications WO2010/053572 (and particularly, CI 2-200 described at paragraph [00225]) and WO2012/170930, both of which are incorporated herein by reference, HGT4003, HGT5000, HGTS001, HGT5001, HGT5002 (see US2015/0140070A1).

In embodiments, the cationic lipid may be an amino lipid.

Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.CI), 1,2-dilinoleoyl-3-trimethylaminopropane chloride salt (DLin-TAP.CI), 1,2-dilinoleyloxy-3-(N-methylpiperazino)propane (DLin-MPZ), 3-(N,Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

In embodiments, the cationic lipid may an aminoalcohol lipidoid.

Aminoalcohol lipidoids which may be used in the present invention may be prepared by the methods described in U.S. Pat. No. 8,450,298, herein incorporated by reference in its entirety. Suitable (ionizable) lipids can also be the compounds as disclosed in Tables 1, 2 and 3 and as defined in claims 1-24 of WO2017/075531A1, hereby incorporated by reference.

In another embodiment, suitable lipids can also be the compounds as disclosed in WO2015/074085A1 (i.e. ATX-001 to ATX-032 or the compounds as specified in claims 1-26), U.S. Appl. Nos. 61/905,724 and Ser. No. 15/614,499 or U.S. Pat. Nos. 9,593,077 and 9,567,296 hereby incorporated by reference in their entirety.

In other embodiments, suitable cationic lipids can also be the compounds as disclosed in WO2017/117530A1 (i.e. lipids 13, 14, 15, 16, 17, 18, 19, 20, or the compounds as specified in the claims), hereby incorporated by reference in its entirety.

In preferred embodiments, ionizable or cationic lipids may also be selected from the lipids disclosed in WO2018/078053A1 (i.e. lipids derived from formula I, II, and III of WO2018/078053A1, or lipids as specified in claims 1 to 12 of WO2018/078053A1), the disclosure of WO2018/078053A1 hereby incorporated by reference in its entirety. In that context, lipids disclosed in Table 7 of WO2018/078053A1 (e.g. lipids derived from formula II-1 to I-41) and lipids disclosed in Table 8 of WO2018/078053A1 (e.g. lipids derived from formula II-1 to II-36) may be suitably used in the context of the invention. Accordingly, formula I-1 to formula I-41 and formula II-1 to formula II-36 of WO2018/

078053A1, and the specific disclosure relating thereto, are herewith incorporated by reference.

In preferred embodiments, cationic lipids may be derived from formula III of published PCT patent application WO2018/078053A1. Accordingly, formula III of WO2018/078053A1, and the specific disclosure relating thereto, are herewith incorporated by reference.

In particularly preferred embodiments, the at least one RNA, preferably the at least one mRNA of the composition is complexed with one or more lipids thereby forming LNPs, wherein the cationic lipid of the LNP is selected from structures III-1 to III-36 of Table 9 of published PCT patent application WO2018/078053A1. Accordingly, formula III-1 to III-36 of WO2018/078053A1, and the specific disclosure relating thereto, are herewith incorporated by reference.

In particularly preferred embodiment of the second aspect, the at least one RNA, preferably the at least one mRNA is complexed with one or more lipids thereby forming LNPs, wherein the LNPs comprises a cationic lipid according to formula III-3:

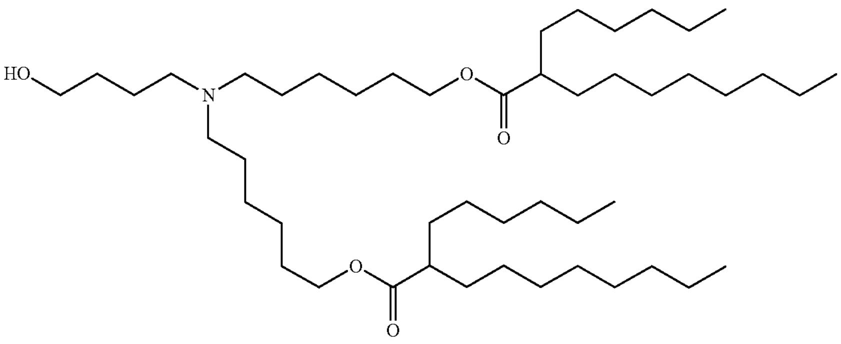

(III-3)

The lipid of formula III-3 as suitably used herein has the chemical term ((4-hydroxybutyl)azanediyl)bis(hexane-6,1-diyl)bis(2-hexyldecanoate), also referred to as ALC-0315.

In certain embodiments, the cationic lipid as defined herein, more preferably cationic lipid compound III-3, is present in the LNP in an amount from about 30 to about 95 mole percent, relative to the total lipid content of the LNP. If more than one cationic lipid is incorporated within the LNP, such percentages apply to the combined cationic lipids. In embodiments, the cationic lipid is present in the LNP in an amount from about 30 to about 70 mole percent. In one embodiment, the cationic lipid is present in the LNP in an amount from about 40 to about 60 mole percent, such as about 40, 41, 42, 43, 44, 45, 46, 47, 48, 49, 50, 51, 52, 53, 54, 55, 56, 57, 58, 59 or 60 mole percent, respectively. In embodiments, the cationic lipid is present in the LNP in an amount from about 47 to about 48 mole percent, such as about 47.0, 47.1, 47.2, 47.3, 47.4, 47.5, 47.6, 47.7, 47.8, 47.9, 50.0 mole percent, respectively, wherein 47.7 mole percent are particularly preferred.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of cationic lipid to RNA is from about 3 to about 15, such as from about 5 to about 13 or from about 7 to about 11.

Other suitable (cationic or ionizable) lipids are disclosed in WO2009/086558, WO2009/127060, WO2010/048536, WO2010/054406, WO2010/088537, WO2010/129709, WO2011/153493, WO 2013/063468, US2011/0256175, US2012/0128760, US2012/0027803, U.S. Pat. No. 8,158,601, WO2016/118724, WO2016/118725, WO2017/070613, WO2017/070620, WO2017/099823, WO2012/040184, WO2011/153120, WO2011/149733, WO2011/090965, WO2011/043913, WO2011/022460, WO2012/061259, WO2012/054365, WO2012/044638, WO2010/080724, WO2010/21865, WO2008/103276, WO2013/086373, WO2013/086354, U.S. Pat. Nos. 7,893,302, 7,404,969, 8,283,333, 8,466,122 and 8,569,256 and US Patent Publication No. US2010/0036115, US2012/0202871, US2013/0064894, US2013/0129785, US2013/0150625, US2013/0178541, US2013/0225836, US2014/0039032 and WO2017/112865. In that context, the disclosures of WO2009/086558, WO2009/127060, WO2010/048536, WO2010/054406, WO2010/088537, WO2010/129709, WO2011/153493, WO 2013/063468, US2011/0256175, US2012/0128760, US2012/0027803, U.S. Pat. No. 8,158,601, WO2016/118724, WO2016/118725, WO2017/070613, WO2017/070620, WO2017/099823, WO2012/040184, WO2011/153120, WO2011/149733, WO2011/090965, WO2011/043913, WO2011/022460, WO2012/061259, WO2012/054365, WO2012/044638, WO2010/080724, WO2010/21865, WO2008/103276, WO2013/086373, WO2013/086354, U.S. Pat. Nos. 7,893,302, 7,404,969, 8,283,333, 8,466,122 and 8,569,256 and US Patent Publication No. US2010/0036115, US2012/0202871, US2013/0064894, US2013/0129785, US2013/0150625, US2013/0178541, US2013/0225836 and US2014/0039032 and WO2017/112865 specifically relating to (cationic) lipids suitable for LNPs are incorporated herewith by reference.

In embodiments, amino or cationic lipids as defined herein have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of lipids have to be present in the charged or neutral form.

Lipids having more than one protonatable or deprotonatable group, or which are zwitterionic, are not excluded and may likewise suitable in the context of the present invention. In some embodiments, the protonatable lipids have a pKa of the protonatable group in the range of about 4 to about 11, e.g., a pKa of about 5 to about 7.

LNPs can comprise two or more (different) cationic lipids as defined herein. Cationic lipids may be selected to contribute to different advantageous properties. For example, cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the nucleic acid which is used as cargo. The N/P ratio may be calculated on the basis that, for example, 1 ug RNA typically contains about 3nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In vivo characteristics and behavior of LNPs can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids or PEGylated cholesterol).

polyethylene glycol-lipid is N-[(methoxy poly(ethylene glycol)2000)carbamyl]-1,2-dimyristyloxlpropyl-3-amine (PEG-c-DMA). In a preferred embodiment, the polyethylene glycol-lipid is PEG-2000-DMG. In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidylethanoloamine (PEG-PE), a PEG succinate diacylglycerol (PEG-S-DAG) such as 4-O-(2',3'-di(tetradecanoyloxy)propyl-1-O-(ω-methoxy(polyethoxy) ethyl)butanedioate (PEG-S-DMG), a PEGylated ceramide (PEG-cer), or a PEG dialkoxypropylcarbamate such as ω-methoxy(polyethoxy)ethyl-N-(2,3di(tetradecanoxy)propyl)carbamate or 2,3-di(tetradecanoxy)propyl-N-(ω-methoxy(polyethoxy)ethyl)carbamate.

In preferred embodiments, the PEGylated lipid is preferably derived from formula (IV) of published PCT patent application WO2018/078053A1. Accordingly, PEGylated lipids derived from formula (IV) of published PCT patent application WO2018/078053A1, and the respective disclosure relating thereto, are herewith incorporated by reference.

In a particularly preferred embodiments, the at least one RNA of the composition is complexed with one or more lipids thereby forming LNPs, wherein the LNP comprises a PEGylated lipid, wherein the PEG lipid is preferably derived from formula (IVa) of published PCT patent application WO2018/078053A1. Accordingly, PEGylated lipid derived from formula (IVa) of published PCT patent application WO2018/078053A1, and the respective disclosure relating thereto, is herewith incorporated by reference.

In a particularly preferred embodiment, the at least one RNA is complexed with one or more lipids thereby forming lipid nanoparticles (LNP), wherein the LNP comprises a PEGylated lipid/PEG lipid. Preferably, said PEG lipid is of formula (IVa):

(IVa)

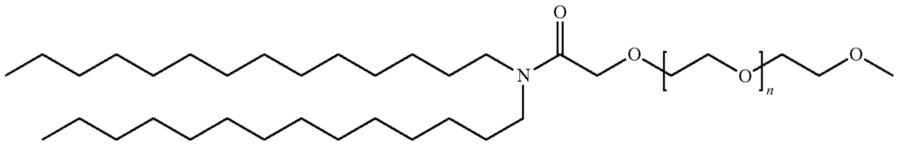

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

A polymer conjugated lipid as defined herein, e.g. a PEG-lipid, may serve as an aggregation reducing lipid.

In certain embodiments, the LNP comprises a stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the wherein n has a mean value ranging from 30 to 60, such as about 30±2, 32±2, 34±2, 36±2, 38±2, 40±2, 42±2, 44±2, 46±2, 48±2, 50±2, 52±2, 54±2, 56±2, 58±2, or 60±2. In a most preferred embodiment n is about 49. In further preferred aspects said PEG lipid is of formula (IVa) wherein n is an integer selected such that the average molecular weight of the PEG lipid is about 2000 g/mol to about 3000 g/mol or about 2300 g/mol to about 2700 g/mol, even more preferably about 2500 g/mol.

The lipid of formula IVa as suitably used herein has the chemical term 2[(polyethylene glycol)-2000]-N,N-ditetradecylacetamide, also referred to as ALC-0159.

Further examples of PEG-lipids suitable in that context are provided in US2015/0376115A1 and WO2015/199952, each of which is incorporated by reference in its entirety.

In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2,5%, about 2%, about 1.5%, about 1%, about 0.5%, or about 0.3% on a molar basis (based on 100% total moles of lipids in the LNP). In preferred embodiments, LNPs comprise from about 1.0% to about 2.0% of the PEG-modified lipid on a molar basis, e.g., about 1.2 to about 1.9%, about 1.2 to about 1.8%, about 1.3 to about 1.8%, about 1.4 to about 1.8%, about 1.5 to about 1.8%, about 1.6 to about 1.8%, in particular about 1.4%, about 1.5%, about 1.6%, about 1.7%, about 1.8%, about 1.9%, most preferably 1.7% (based on 100% total moles of lipids in the LNP). In various embodiments, the molar ratio of the cationic lipid to the PEGylated lipid ranges from about 100:1 to about 25:1.

In preferred embodiments, the LNP comprises one or more additional lipids, which stabilize the formation of particles during their formation or during the manufacturing process (e.g. neutral lipid and/or one or more steroid or steroid analogue).

In preferred embodiments of the second aspect, the at least one RNA is complexed with one or more lipids thereby forming lipid nanoparticles (LNP), wherein the LNP comprises one or more neutral lipid and/or one or more steroid or steroid analogue.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

In embodiments of the second aspect, the LNP comprises one or more neutral lipids, wherein the neutral lipid is selected from the group comprising distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1 carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanol amine (SOPE), and 1,2-dielaidoyl-sn-glycero-3-phophoethanolamine (transDOPE), or mixtures thereof.

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

In preferred embodiments, the neutral lipid is 1,2-distearoyl-sn-glycero-3-phosphocholine (DSPC). The molar ratio of the cationic lipid to DSPC may be in the range from about 2:1 to about 8:1.

In preferred embodiments, the steroid is cholesterol. The molar ratio of the cationic lipid to cholesterol may be in the range from about 2:1 to about 1:1. In some embodiments, the cholesterol may be PEGylated.

The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

Preferably, lipid nanoparticles (LNPs) comprise: (a) the at least one RNA of the first aspect, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, the cationic lipids (as defined above), non-cationic lipids (as defined above), cholesterol (as defined above), and/or PEG-modified lipids (as defined above) may be combined at various relative molar ratios. For example, the ratio of cationic lipid to non-cationic lipid to cholesterol-based lipid to PEGylated lipid may be between about 30-60:20-35:20-30:1-15, or at a ratio of about 40:30:25:5, 50:25:20:5, 50:27:20:3, 40:30:20:10, 40:32:20:8, 40:32:25:3 or 40:33:25:2, or at a ratio of about 50:25:20:5, 50:20:25:5, 50:27:20:3 40:30:20:10,40:30:25:5 or 40:32:20:8, 40:32:25:3 or 40:33:25:2, respectively.

In some embodiments, the LNPs comprise a lipid of formula (III), the at least one RNA as defined herein, a neutral lipid, a steroid and a PEGylated lipid. In preferred embodiments, the lipid of formula (III) is lipid compound III-3 (ALC-0315), the neutral lipid is DSPC, the steroid is cholesterol, and the PEGylated lipid is the compound of formula (IVa) (ALC-0159).

In a preferred embodiment of the second aspect, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid:5-25% neutral lipid:25-55% sterol; 0.5-15% PEG-lipid.

In particularly preferred embodiments, the at least RNA is complexed with one or more lipids thereby forming lipid nanoparticles (LNP), wherein the LNP comprises (i) at least one cationic lipid as defined herein, preferably a lipid of formula (III), more preferably lipid III-3 (ALC-0315);

(ii) at least one neutral lipid as defined herein, preferably 1,2-distearoyl-sn-glycero-3-phosphocholine (DSPC);

(iii) at least one steroid or steroid analogue as defined herein, preferably cholesterol; and (iv) at least one PEG-lipid as defined herein, e.g. PEG-DMG or PEG-cDMA, preferably a PEGylated lipid that is or is derived from formula (IVa) (ALC-0159).

In particularly preferred embodiments, the at least one RNA is complexed with one or more lipids thereby forming lipid nanoparticles (LNP), wherein the LNP comprises (i) to (iv) in a molar ratio of about 20-60% cationic lipid: 5-25% neutral lipid: 25-55% sterol; 0.5-15% PEG-lipid.

In one preferred embodiment, the lipid nanoparticle comprises: a cationic lipid with formula (III) and/or PEG lipid with formula (IV), optionally a neutral lipid, preferably 1,2-distearoyl-sn-glycero-3-phosphocholine (DSPC) and optionally a steroid, preferably cholesterol, wherein the molar ratio of the cationic lipid to DSPC is optionally in the range from about 2:1 to 8:1, wherein the molar ratio of the cationic lipid to cholesterol is optionally in the range from about 2:1 to 1.1.

In a particular preferred embodiment, the composition of the second aspect comprising the at least one RNA, comprises lipid nanoparticles (LNPs), which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3 (ALC-0315)), DSPC, cholesterol and PEG-lipid (preferably PEG-lipid of formula (IVa) with n=49, even more preferably PEG-lipid of formula (IVa) with n=45 (ALC-0159)); solubilized in ethanol).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 24837-24854, 27524-27546, 24855-24872, 27547-27569, 24909-24926, 27616-27638, 28827-28866, 28687-28735, 28867-28915, 28929-28932, 28937-28940 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27532, 27555, 27624, 28852, 28699-28704, 28879-28884 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27532, 27555, 27624, 28852 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 28688-28691, 28868-28871, 28929-28932, 28937-28940 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-28686, 28777-28825, 28925-28928, 28933-28936 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27394, 27417, 27486, 28762, 28650-28655, 28789-28794 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27394, 27417, 27486, 28762 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

Preferably, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 28639-28642, 28778-28781, 28925-28928, 28933-28936 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

In embodiments where the composition is a multivalent composition as defined above, the RNA species, preferably mRNA species of the multivalent composition may be formulated separately, e.g. may be formulated separately in liposomes or LNPs. Suitably, the RNA species of the multivalent composition are separately formulated in LNPs which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45). Nucleic acid species for multivalent compositions are preferably selected as defined above (see section "Multivalent compositions of the invention").

In that context, the composition may comprise

- at least one RNA, which is identical or at least 90%, 91%, 92%, 93%, 94%, 95%, 96%, 97%, 98%, or 99% identical to a nucleic acid sequence of SEQ ID NO: 149 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or
- at least one RNA, which is identical or at least 90%, 91%, 92%, 93%, 94%, 95%, 96%, 97%, 98%, or 99% identical to a nucleic acid sequence of SEQ ID NOs: 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-28686, 28777-28825, 28925-28928, 28933-28936 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 27394, 27417, 27486, 28762, 28650-28655, 28789-28794 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 27394, 27417, 27486, 28762 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 28639-28642, 28778-28781, 28925-28928, 28933-28936 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

In that context, the composition may comprise at least one RNA, which is identical or at least 90%, 91%, 92%, 93%, 94%, 95%, 96%, 97%, 98%, or 99% identical to a nucleic acid sequence of SEQ ID NO: 24837 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 24837-24854, 27524-27546, 24855-24872, 27547-27569, 24909-24926, 27616-27638, 28827-28866, 28687-28735, 28867-28915, 28929-28932, 28937-28940 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 27532, 27555, 27624, 28852, 28699-28704, 28879-28884 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 27532, 27555, 27624, 28852 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to a nucleic acid sequence of SEQ ID NOs: 28688-28691, 28868-28871, 28929-28932, 28937-28940 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)).

In embodiments where the composition is a multivalent composition as defined above, the nucleic acid species (e.g. DNA or RNA), preferably RNA species of the multivalent composition may be co-formulated, preferably co-formulated in liposomes or LNPs. Suitably, the RNA species of the multivalent composition are co-formulated in LNPs which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45). Nucleic acid species for multivalent compositions are preferably selected as defined above (see section "Multivalent compositions of the invention")

The total amount of RNA in the lipid nanoparticles may vary and is defined depending on the e.g. nucleic acid to total lipid w/w ratio. In one embodiment of the invention the nucleic acid, in particular the RNA to total lipid ratio is less than 0.06 w/w, preferably between 0.03 w/w and 0.04 w/w.

In some embodiments, the lipid nanoparticles (LNPs), which are composed of only three lipid components, namely imidazole cholesterol ester (ICE), 1,2-dioleoyl-sn-glycero-3-phosphoethanolamine (DOPE), and 1,2-dimyristoyl-sn-glycerol, methoxypolyethylene glycol (DMG-PEG-2K).

In one embodiment, the lipid nanoparticle of the composition comprises a cationic lipid, a steroid; a neutral lipid; and a polymer conjugated lipid, preferably a pegylated lipid. Preferably, the polymer conjugated lipid is a pegylated lipid or PEG-lipid. In a specific embodiment, lipid nanoparticles comprise a cationic lipid resembled by the cationic lipid COATSOME® SS-EC (former name: SS-33/4PE-15; NOF Corporation, Tokyo, Japan), in accordance with the following formula

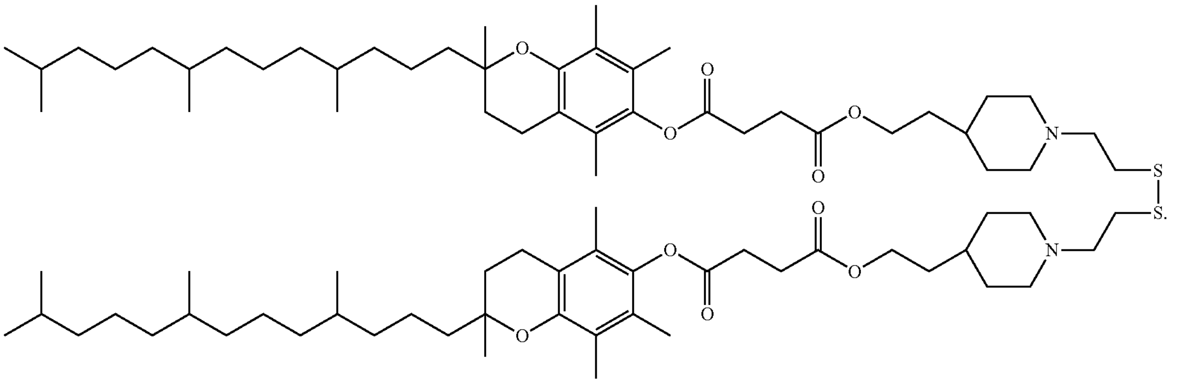 [SMILES: Cc1c(C)c2c(c(C)c1OC(=O)CCC(=O)OCCC1CCN(CCSSCCN3CCC(CCOC(=O)CCC(=O)Oc4c(C)c(C)c5c(c4C)CCC(C)(CCCC(C)CCCC(C)CCCC(C)C)O5)CC3)CC1)CCC(C)(CCCC(C)CCCC(C)CCCC(C)C)O2]

As described further below, those lipid nanoparticles are termed "GN01".

Furthermore, in a specific embodiment, the GN01 lipid nanoparticles comprise a neutral lipid being resembled by the structure 1,2-diphytanoyl-sn-glycero-3-phosphoethanolamine (DPhyPE):

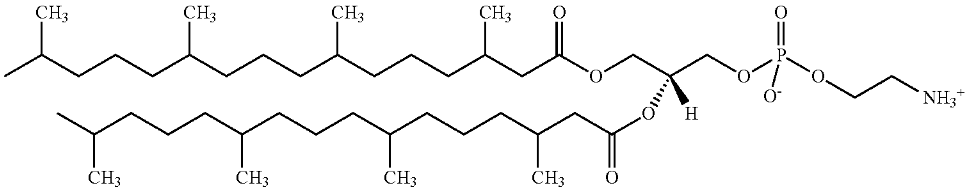 [SMILES: CC(C)CCCC(C)CCCC(C)CCCC(C)CC(=O)OC[C@H](COP(=O)([O-])OCC[NH3+])OC(=O)CC(C)CCCC(C)CCCC(C)CCCC(C)C]

Furthermore, in a specific embodiment, the GN01 lipid nanoparticles comprise a polymer conjugated lipid, preferably a pegylated lipid, being 1,2-dimyristoyl-rac-glycero-3-methoxwolyethylene glycol 2000 (DMG-PEG 2000) having the following structure:

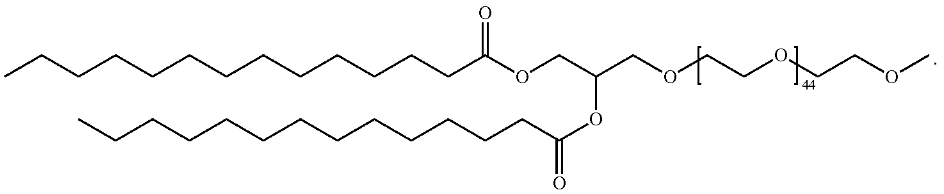

As used in the art, "DMG-PEG 2000" is considered a mixture of 1,2-DMG-PEG 2000 and 1,3-DMG-PEG 2000 in ~97:3 ratio.

Accordingly, GN01 lipid nanoparticles (GN01-LNPs) according to one of the preferred embodiments comprise a SS-EC cationic lipid, neutral lipid DPhyPE, cholesterol, and the polymer conjugated lipid (pegylated lipid) 1,2-dimyristoyl-rac-glycero-3-methoxypolyethylene glycol (PEG-DMG).

In a preferred embodiment, the GN01 LNPs comprise:

(a) cationic lipid SS-EC (former name: SS-33/4PE-15; NOF Corporation, Tokyo, Japan) at an amount of 45-65 mol %;

(b) cholesterol at an amount of 25-45 mol %;

(c) DPhyPE at an amount of 8-12 mol %; and (d) PEG-DMG 2000 at an amount of 1-3 mol %;

each amount being relative to the total molar amount of all lipidic excipients of the GN01 lipid nanoparticles.

In a further preferred embodiment, the GN01 lipid nanoparticles as described herein comprises 59 mol % cationic lipid, 10 mol % neutral lipid, 29.3 mol % steroid and 1.7 mol % polymer conjugated lipid, preferably pegylated lipid. In a most preferred embodiment, the GN01 lipid nanoparticles as described herein comprise 59 mol % cationic lipid SS-EC, 10 mol % DPhyPE, 29.3 mol % cholesterol and 1.7 mol % DMG-PEG 2000.

The amount of the cationic lipid relative to that of the nucleic acid in the GN01 lipid nanoparticle may also be expressed as a weight ratio (abbreviated f.e. "m/m"). For example, the GN01 lipid nanoparticles comprise the at least one nucleic acid, preferably the at least one RNA at an amount such as to achieve a lipid to RNA weight ratio in the range of about 20 to about 60, or about 10 to about 50. In other embodiments, the ratio of cationic lipid to nucleic acid or RNA is from about 3 to about 15, such as from about 5 to about 13, from about 4 to about 8 or from about 7 to about 11. In a very preferred embodiment of the present invention, the total lipid/RNA mass ratio is about 40 or 40, i.e. about 40 or 40 times mass excess to ensure RNA encapsulation. Another preferred RNA/lipid ratio is between about 1 and about 10, about 2 and about 5, about 2 and about 4, or preferably about 3.

Further, the amount of the cationic lipid may be selected taking the amount of the nucleic acid cargo such as the RNA compound into account. In one embodiment, the N/P ratio can be in the range of about 1 to about 50. In another embodiment, the range is about 1 to about 20, about 1 to about 10, about 1 to about 5. In one preferred embodiment, these amounts are selected such as to result in an N/P ratio of the GN01 lipid nanoparticles or of the composition in the range from about 10 to about 20. In a further very preferred embodiment, the N/P is 14 (i.e. 14 times mol excess of positive charge to ensure nucleic acid encapsulation).

In a preferred embodiment, GN01 lipid nanoparticles comprise 59 mol % cationic lipid COATSOME® SS-EC (former name: SS-33/4PE-15 as apparent from the examples section; NOF Corporation, Tokyo, Japan), 29.3 mol % cholesterol as steroid, 10 mol % DPhyPE as neutral lipid/phospholipid and 1.7 mol % DMG-PEG 2000 as polymer conjugated lipid. A further inventive advantage connected with the use of DPhyPE is the high capacity for fusogenicity due to its bulky tails, whereby it is able to fuse at a high level with endosomal lipids. For "GN01", N/P (lipid to nucleic acid, e.g RNA mol ratio) preferably is 14 and total lipid/RNA mass ratio preferably is 40 (m/m).

In other embodiments, the at least one RNA, preferably the at least one mRNA is complexed with one or more lipids thereby forming lipid nanoparticles (LNP), wherein the LNP comprises I at least one cationic lipid;

Ii at least one neutral lipid;

Iii at least one steroid or steroid analogue; and

Iiii at least one PEG-lipid as defined herein, wherein the cationic lipid is DLin-KC2-DMA (50 mol %) or DLin-MC3-DMA (50 mol %), the neutral lipid is DSPC (10 mol %), the PEG lipid is PEG-DOMG (1.5 mol %) and the structural lipid is cholesterol (38.5 mol %).

In other embodiments, the at least one RNA, preferably the at least one mRNA is complexed with one or more lipids thereby forming lipid nanoparticles (LNP), wherein the LNP comprises SS15/Chol/DOPE (or DOPC)/DSG-5000 at mol % 50/38.5/10/1.5.

In other embodiments, the RNA of the invention may be formulated in liposomes, e.g. in liposomes as described in WO2019/222424, WO2019/226925, WO2019/232095, WO2019/232097, or WO2019/232208, the disclosure of WO2019/222424, WO2019/226925, WO2019/232095, WO2019/232097, or WO2019/232208 relating to liposomes or lipid-based carrier molecules herewith incorporated by reference.

In various embodiments, LNPs that suitably encapsulates the at least one RNA of the invention have a mean diameter of from about 50 nm to about 200 nm, from about 60 nm to about 200 nm, from about 70 nm to about 200 nm, from about 80 nm to about 200 nm, from about 90 nm to about 200 nm, from about 90 nm to about 190 nm, from about 90 nm to about 180 nm, from about 90 nm to about 170 nm, from about 90 nm to about 160 nm, from about 90 nm to about 150 nm, from about 90 nm to about 140 nm, from about 90 nm to about 130 nm, from about 90 nm to about 120 nm, from about 90 nm to about 100 nm, from about 70 nm to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, 150 nm, 160 nm, 170 nm, 180 nm, 190 nm, or 200 nm and are substantially non-toxic. As used herein, the mean diameter may be represented by the z-average as determined by dynamic light scattering as commonly known in the art.

The polydispersity index (PDI) of the nanoparticles is typically in the range of 0.1 to 0.5. In a particular embodiment, a PDI is below 0.2. Typically, the PDI is determined by dynamic light scattering.

In another preferred embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

In another preferred embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

In embodiments where more than one or a plurality, e.g. 2, 3, 4, 5, 6, 7, 8, 9, 10, 11, 12, 13, 14, 15 of RNA species of the invention are comprised in the composition, said more than one or said plurality e.g. 2, 3, 4, 5, 6, 7, 8, 9, 10, 11, 12, 13, 14, 15 of RNA species of the invention may be complexed within one or more lipids thereby forming LNPs comprising more than one or a plurality, e.g. 2, 3, 4, 5, 6, 7, 8, 9, 10, 11, 12, 13, 14, 15 of different RNA species.

According to a preferred embodiment the LNPs preferably encapsulating or comprising RNA are purified by at least one purification step, preferably by at least one step of TFF and/or at least one step of clarification and/or at least one step of filtration. This purification particularly leads to reducing the amount of ethanol in the composition, which has been used for the lipid formulation.

In this context it is particularly preferred that the composition comprises after purification less than about 500ppM ethanol, preferably less than about 50ppM ethanol, more preferably less than about 5ppM ethanol.

In embodiments, the LNPs described herein may be lyophilized in order to improve storage stability of the formulation and/or the RNA. In embodiments, the LNPs described herein may be spray dried in order to improve storage stability of the formulation and/or the nucleic acid. Lyoprotectants for lyophilization and or spray drying may be selected from trehalose, sucrose, mannose, dextran and inulin. A preferred lyoprotectant is sucrose, optionally comprising a further lyoprotectant. A further preferred lyoprotectant is trehalose, optionally comprising a further lyoprotectant.

Accordingly, the composition, e.g. the composition comprising LNPs is lyophilized (e.g. according to WO2016/165831 or WO2011/069586, each of which is hereby incorporated in its entirety by reference) to yield a temperature stable dried nucleic acid (powder) composition as defined herein (e.g. RNA or DNA). The composition, e.g. the composition comprising LNPs may also be dried using spray-drying or spray-freeze drying (e.g. according to WO2016/184575 or WO2016/184576) to yield a temperature stable composition (powder) as defined herein.

Accordingly, in preferred embodiments, the composition is a dried composition.

The term "dried composition" as used herein has to be understood as composition that has been lyophilized, or spray-dried, or spray-freeze dried as defined above to obtain a temperature stable dried composition (powder) e.g. comprising LNP complexed RNA (as defined above).

According to further embodiments, the composition of the second aspect may comprise at least one adjuvant.

Suitably, the adjuvant is preferably added to enhance the immunostimulatory properties of the composition.

The term "adjuvant" as used herein will be recognized and understood by the person of ordinary skill in the art, and is for example intended to refer to a pharmacological and/or immunological agent that may modify, e.g. enhance, the effect of other agents or that may be suitable to support administration and delivery of the composition. The term "adjuvant" refers to a broad spectrum of substances. Typically, these substances are able to increase the immunogenicity of antigens. For example, adjuvants may be recognized by the innate immune systems and, e.g., may elicit an innate immune response (that is, a non-specific immune response). "Adjuvants" typically do not elicit an adaptive immune response. In the context of the invention, adjuvants may enhance the effect of the antigenic peptide or protein provided by the nucleic acid. In that context, the at least one adjuvant may be selected from any adjuvant known to a skilled person and suitable for the present case, i.e. supporting the induction of an immune response in a subject, e.g. in a human subject.

Accordingly, the composition of the second aspect may comprise at least one adjuvant, wherein the at least one adjuvant may be suitably selected from any adjuvant provided in WO2016/203025, which is hereby incorporated by reference. Adjuvants disclosed in any of the claims 2 to 17 of WO2016/203025, preferably adjuvants disclosed in claim 17 of WO2016/203025 are particularly suitable, the specific content relating thereto herewith incorporated by reference. Adjuvants may suitably used and comprised in the composition of the second aspect, or the vaccine of the forth aspect, to e.g. reduce the amount of nucleic acid required for a sufficient immune response against the encoded protein and/or to improve the efficacy of the composition/the vaccine for treatment/vaccination of the elderly. A suitable adjuvant in the context of a coronavirus composition or vaccine (in particular for compositions comprising a polypeptide of the third aspect) may be a Toll-like receptor 9 (TLR9) agonist adjuvant, CpG 1018TM.

The composition of the second aspect may comprise, besides the components specified herein, at least one further component which may be selected from the group consisting of further antigens (e.g. in the form of a peptide or protein, preferably derived from a coronavirus) or further antigen-encoding nucleic acids (preferably encoding peptide or protein, preferably derived from a coronavirus); a further immunotherapeutic agent; one or more auxiliary substances (cytokines, such as monokines, lymphokines, interleukins or chemokines); or any further compound, which is known to be immune stimulating due to its binding affinity (as ligands) to human Toll-like receptors; and/or an adjuvant nucleic acid, preferably an immunostimulatory RNA (isRNA), e.g. CpG-RNA etc.

In preferred embodiments, the composition comprising lipid-based carriers (e.g. LNPs) encapsulating the at least one RNA is stable after storage as a liquid, for example stable for at least 2 weeks after storage as a liquid at temperatures of about 5° C.

As used herein, "stable" refers to a liquid composition comprising lipid-based carriers (e.g. LNPs) encapsulating an RNA where the measured values for various physiochemical parameters are within a defined range after storage. In one embodiment, the liquid composition comprising lipid-based carriers encapsulating an RNA is analyzed to assess stability according to various parameters. Suitable stability parameters include, without limitation, RNA integrity, Z-average particle size, polydispersity index (PDI), the amount of free RNA in the liquid composition, encapsulation efficiency of the RNA (proportion of the RNA in percent incorporated with lipid-based carriers), shape and morphology of the lipid-based carriers encapsulating an RNA, pH, osmolality, or turbidity. Further, "stable" refers to a liquid composition comprising lipid-based carriers encapsulating an RNA where the measured values for various functional parameters are within a defined range after storage. In one embodiment, the liquid composition comprising lipid-based carriers encapsulating an RNA is analyzed to assess the potency of the liquid composition including for example the expression of the encoded peptide or protein, the induction of specific antibody titers, the induction of neutralizing antibody titers, the induction of T-cell, the reactogenicity of the liquid composition including for example the induction of innate immune responses ect.

In preferred embodiments, the term "stable" refers to RNA integrity.

The term "RNA integrity" generally describes whether the complete RNA sequence is present in the liquid composition. Low RNA integrity could be due to, amongst others, RNA degradation, RNA cleavage, incorrect or incomplete chemical synthesis of the RNA, incorrect base pairing, integration of modified nucleotides or the modification of already integrated nucleotides, lack of capping or incomplete capping, lack of polyadenylation or incomplete polyadenylation, or incomplete RNA in vitro transcription. RNA is a fragile molecule that can easily degrade, which may be caused e.g. by temperature, ribonucleases, pH or other factors (e.g. nucleophilic attacks, hydrolysis etc.), which may reduce the RNA integrity and, consequently, the functionality of the RNA.

In preferred embodiments, the RNA of a composition has an RNA integrity of at least about 50%, preferably of at least about 60%, more preferably of at least about 70%, most preferably of at least about 80% or about 90%. RNA is suitably determined using analytical HPLC, preferably analytical RP-HPLC.

The skilled person can choose from a variety of different chromatographic or electrophoretic methods for determining an RNA integrity. Chromatographic and electrophoretic methods are well-known in the art. In case chromatography is used (e.g. RP-HPLC), the analysis of the integrity of the RNA may be based on determining the peak area (or "area under the peak") of the full length RNA in a corresponding chromatogram. The peak area may be determined by any suitable software which evaluates the signals of the detector system. The process of determining the peak area is also referred to as integration. The peak area representing the full length RNA is typically set in relation to the peak area of the total RNA in a respective sample. The RNA integrity may be expressed in % RNA integrity.

In the context of aspects of the invention, RNA integrity may be determined using analytical (RP)HPLC. Typically, a test sample of the liquid composition comprising lipid based carrier encapsulating RNA may be treated with a detergent (e.g. about 2% Triton X100) to dissociate the lipid based carrier and to release the encapsulated RNA. The released RNA may be captured using suitable binding compounds, e.g. Agencourt AMPure XP beads (Beckman Coulter, Brea, Calif., USA) essentially according to the manufacturer's instructions. Following preparation of the RNA sample, analytical (RP)HPLC may be performed to determine the integrity of RNA. Typically, for determining RNA integrity, the RNA samples may be diluted to a concentration of 0.1 g/l using e.g. water for injection (WFI). About 10 μl of the diluted RNA sample may be injected into an HPLC column (e.g. a monolithic poly(styrene-divinylbenzene) matrix). Analytical (RP)HPLC may be performed using standard conditions, for example: Gradient 1: Buffer A (0.1M TEAA (pH 7.0)); Buffer B (0.1M TEAA (pH 7.0) containing 25% acetonitrile). Starting at 30% buffer B the gradient extended to 32% buffer B in 2 min, followed by an extension to 55% buffer B over 15 minutes at a flow rate of 1 ml/min. HPLC chromatograms are typically recorded at a wavelength of 260 nm. The obtained chromatograms may be evaluated using a software and the relative peak area may be determined in percent (%) as commonly known in the art. The relative peak area indicates the amount of RNA that has 100% RNA integrity. Since the amount of the RNA injected into the HPLC is typically known, the analysis of the relative peak area provides information on the integrity of the RNA. Thus, if e.g. 100 ng RNA have been injected in total, and 100 ng are determined as the relative peak area, the RNA integrity would be 100%. If, for example, the relative peak area would correspond to 80 ng, the RNA integrity would be 80%. Accordingly, RNA integrity in the context of the invention is determined using analytical HPLC, preferably analytical RP-HPLC.

In preferred embodiments, 80% of RNA comprised in the liquid composition is encapsulated, preferably 85% of the RNA comprised in the composition is encapsulated, 90% of the RNA comprised in the composition is encapsulated, most preferably 95% or more of the RNA comprised in the composition is encapsulated. The percentage of encapsulation may be determined by a Ribogreen assay as known in the art.

In embodiments, the composition comprises at least one antagonist of at least one RNA sensing pattern recognition receptor. Such an antagonist may preferably be co-formulated in lipid-based carriers as defined herein.

Suitable antagonist of at least one RNA sensing pattern recognition receptor are disclosed in PCT patent application PCT/EP2020/072516, the full disclosure herewith incorporated by reference. In particular, the disclosure relating to suitable antagonist of at least one RNA sensing pattern recognition receptors as defined in any one of the claims 1 to 94 of PCT/EP2020/072516 are incorporated.

In preferred embodiments, the composition comprises at least one antagonist of at least one RNA sensing pattern recognition receptor selected from a Toll-like receptor, preferably TLR7 and/or TLR8.

In embodiments, the at least one antagonist of at least one RNA sensing pattern recognition receptor is selected from a nucleotide, a nucleotide analog, a nucleic acid, a peptide, a protein, a small molecule, a lipid, or a fragment, variant or derivative of any of these.

In preferred embodiments, the at least one antagonist of at least one RNA sensing pattern recognition receptor is a single stranded oligonucleotide, preferably a single stranded RNA Oligonucleotide.

In embodiments, the antagonist of at least one RNA sensing pattern recognition receptor is a single stranded oligonucleotide that comprises or consists of a nucleic acid sequence identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 85-212 of PCT/EP2020/072516, or fragments of any of these sequences.

In preferred embodiments, the antagonist of at least one RNA sensing pattern recognition receptor is a single stranded oligonucleotide that comprises or consists of a nucleic acid sequence identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 85-87, 149-212 of PCT/EP2020/072516, or fragments of any of these sequences.

A particularly preferred antagonist of at least one RNA sensing pattern recognition receptor in the context of the invention is 5'-GAG CGmG CCA-3' (SEQ ID NO: 85 of PCT/EP2020/072516), or a fragment thereof.

In embodiments, the molar ratio of the at least one antagonist of at least one RNA sensing pattern recognition receptor as defined herein to the at least one nucleic acid, preferably RNA encoding a SRAS-CoV-2 antigenic peptide or protein as defined herein suitably ranges from about 1:1, to about 100:1, or ranges from about 20:1, to about 80:1.

In embodiments, the wherein the weight to weight ratio of the at least one antagonist of at least one RNA sensing pattern recognition receptor as defined herein to the at least one nucleic acid, preferably RNA encoding a SRAS-CoV-2 antigenic peptide or protein as defined herein suitably ranges from about 1:1, to about 1:30, or ranges from about 1:2, to about 1:10.

Vaccine:

In a third aspect, the present invention provides a vaccine, for example a vaccine against a SARS-CoV-2 (formerly nCoV-2019) coronavirus causing COVID-19 disease. The vaccine may be effective against multiple SARS-CoV-2 coronoaviruses. The vaccine may also be effective against both one or more SARS-CoV-2 coronaviruses and one or more non-coronaviruses (e.g., the vaccine may be effective against both a SARS-CoV-2 virus and an influenza virus)>

In preferred embodiments of the fourth aspect, the vaccine comprises at least one nucleic acid (e.g. DNA or RNA), preferably at least one RNA of the first aspect, or the composition of the second aspect.

In other embodiments, the vaccine comprises at least one polypeptide as defined in the third aspect.

In other embodiments, the vaccine comprises at least one plasmid DNA or adenovirus DNA as defined in the first aspect.

Notably, embodiments relating to the composition of the second aspect may likewise be read on and be understood as suitable embodiments of the vaccine of the fourth aspect. Also, embodiments relating to the vaccine of the fourth aspect may likewise be read on and be understood as suitable embodiments of the composition of the second aspect. Furthermore, features and embodiments described in the context of the first aspect (the nucleic acid of the invention) have to be read on and have to be understood as suitable embodiments of the composition of the fourth aspect.

The term “vaccine” will be recognized and understood by the person of ordinary skill in the art, and is for example intended to be a prophylactic or therapeutic material providing at least one epitope or antigen, preferably an immunogen. In the context of the invention the antigen or antigenic function is suitably provided by the inventive nucleic acid of the first aspect (said nucleic acid comprising a coding sequence encoding a antigenic peptide or protein derived from a SARS-CoV-2 coronavirus) or the composition of the second aspect (comprising at least one nucleic acid of the first aspect). In other embodiments, the antigen or antigenic function is provided by the inventive polypeptide of the third aspect.

In preferred embodiments, the vaccine, or the composition of the second aspect, elicits an adaptive immune response, preferably an adaptive immune response against a coronavirus, preferably against SARS-CoV-2 coronavirus.

In particularly preferred embodiments, the vaccine, or the composition of the second aspect, elicits functional antibodies that can effectively neutralize the virus, preferably SARS-CoV-2 coronavirus.

In further preferred embodiments, the vaccine, or the composition of the second aspect, elicits mucosal IgA immunity by inducing of mucosal IgA antibodies.

In particularly preferred embodiments, the vaccine, or the composition of the second aspect, elicits functional antibodies that can effectively neutralize the virus, preferably SARS-CoV-2 coronavirus.

In further particularly preferred embodiments, the vaccine, or the composition of the second aspect, induces broad, functional cellular T-cell responses against coronavirus, preferably against SARS-CoV-2 coronavirus.

In further particularly preferred embodiments, the vaccine, or the composition of the second aspect, induces a well-balanced B cell and T cell response against coronavirus, preferably against SARS-CoV-2 coronavirus.

According to a preferred embodiment, the vaccine as defined herein may further comprise a pharmaceutically acceptable carrier and optionally at least one adjuvant as specified in the context of the second aspect.

Suitable adjuvants in that context may be selected from adjuvants disclosed in claim 17 of WO2016/203025.

In a preferred embodiment, the vaccine is a monovalent vaccine.

The terms "monovalent vaccine", "monovalent composition" "univalent vaccine" or "univalent composition" will be recognized and understood by the person of ordinary skill in the art, and are e.g. intended to refer to a composition or a vaccine comprising only one antigen or antigen construct from a pathogen. Accordingly, said vaccine or composition comprises only one nucleic acid species encoding a single antigen or antigen construct of a single organism. The term "monovalent vaccine" includes the immunization against a single valence. In the context of the invention, a monovalent SARS-CoV-2 coronavirus vaccine or composition would comprise at least one nucleic acid encoding one single antigenic peptide or protein derived from one specific SARS-CoV-2 coronavirus.

In embodiments, the vaccine is a polyvalent vaccine comprising a plurality or at least more than one of the nucleic acid species defined in the context of the first aspect. Embodiments relating to a polyvalent composition as disclosed in the context of the second aspect may likewise be read on and be understood as suitable embodiments of the polyvalent vaccine.

The terms "polyvalent vaccine", "polyvalent composition" "multivalent vaccine" or "multivalent composition" will be recognized and understood by the person of ordinary skill in the art, and are e.g. intended to refer to a composition or a vaccine comprising antigens from more than one virus (e.g. different SARS-CoV-2 coronavirus isolates), or comprising different antigens or antigen constructs of the same SARS-CoV-2 coronavirus, or any combination thereof. The terms describe that said vaccine or composition has more than one valence. In the context of the invention, a polyvalent SARS-CoV-2 coronavirus vaccine would comprise nucleic acid sequences encoding antigenic peptides or proteins derived from several different SARS-CoV-2 coronavirus (e.g. different SARS-CoV-2 coronavirus isolates) or comprising nucleic acid sequences encoding different antigens or antigen constructs from the same SARS-CoV-2 coronavirus, or a combination thereof.

In preferred embodiments, the polyvalent or multivalent vaccine comprises at least one polyvalent composition as defined in the second aspect. Particularly preferred are polyvalent compositions as defined in section "Multivalent compositions of the invention".

In some embodiments, the vaccine comprises at least one antagonist of at least one RNA sensing pattern recognition receptor as defined in the second aspect.

The vaccine typically comprises a safe and effective amount of nucleic acid (e.g. DNA or RNA), preferably RNA of the first aspect or composition of the second aspect (or the polypeptide of the third aspect). As used herein, "safe and effective amount" means an amount of nucleic acid or composition sufficient to significantly induce a positive modification of a disease or disorder related to an infection with coronavirus, preferably SARS-CoV-2 coronavirus. At the same time, a "safe and effective amount" is small enough to avoid serious side-effects. In relation to the nucleic acid, composition, or vaccine of the present invention, the expression "safe and effective amount" preferably means an amount of nucleic acid, composition, or vaccine that is suitable for stimulating the adaptive immune system against coronavirus in such a manner that no excessive or damaging immune reactions (e.g. innate immune responses) are achieved.

A "safe and effective amount" of the nucleic acid, composition, or vaccine as defined above will vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the skilled person. Moreover, the "safe and effective amount" of the nucleic acid, the composition, or vaccine may depend from application/delivery route (intradermal, intramuscular, intranasal), application device (jet injection, needle injection, microneedle patch, electroporation device) and/or complexation/formulation (protamine complexation or LNP encapsulation, DNA or RNA). Moreover, the "safe and effective amount" of the nucleic acid, the composition, or the vaccine may depend from the physical condition of the treated subject (infant, pregnant women, immunocompromised human subject etc.).

The vaccine can be used according to the invention for human medical purposes and also for veterinary medical purposes (mammals, vertebrates, or avian species).

The pharmaceutically acceptable carrier as used herein preferably includes the liquid or non-liquid basis of the vaccine. If the vaccine is provided in liquid form, the carrier will be water, typically pyrogen-free water; isotonic saline or buffered (aqueous) solutions, e.g. phosphate, citrate etc. buffered solutions. Preferably, Ringer-Lactate solution is used as a liquid basis for the vaccine or the composition according to the invention as described in WO2006/122828, the disclosure relating to suitable buffered solutions incorporated herewith by reference. Other preferred solutions used as a liquid basis for the vaccine or the composition, in particular for compositions/vaccines comprising LNPs, comprise sucrose and/or trehalose.

The choice of a pharmaceutically acceptable carrier as defined herein is determined, in principle, by the manner, in which the pharmaceutical composition(s) or vaccine according to the invention is administered. The vaccine is preferably administered locally. Routes for local administration in general include, for example, topical administration routes but also intradermal, transdermal, subcutaneous, or intramuscular injections or intralesional, intracranial, intrapulmonal, intracardial, intraarticular and sublingual injections.

More preferably, composition or vaccines according to the present invention may be administered by an intradermal, subcutaneous, or intramuscular route, preferably by injection, which may be needle-free and/or needle injection. Preferred in the context of the invention is intramuscular injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4.

The vaccine or composition as defined herein may comprise one or more auxiliary substances or adjuvants as defined above in order to further increase the immunogenicity. A synergistic action of the nucleic acid contained in the composition/vaccine and of an auxiliary substance, which may be optionally be co-formulated (or separately formulated) with the vaccine or composition as described above, is preferably achieved thereby. Such immunogenicity increasing agents or compounds may be provided separately (not co-formulated with the vaccine or composition) and administered individually.

The vaccine is preferably provided in lyophilized or spray-dried form (as described in the context of the second aspect). Such a lyophilized or spray-dried vaccine typically comprises trehalose and/or sucrose and is re-constituted in a suitable liquid buffer before administration to a subject. In some aspects, a lyophilized vaccine of the embodiments comprises mRNA of the embodiments complexed with LNPs. In some aspects, a lyophilized composition has a water content of less than about 10%. For example, a lyophilized composition can have a water content of about 0.1% to 10%, 0.1% to 7.5%, or 0.5% to 7.5%, preferably the lyophilized composition has a water content of about 0.5% to about 5.0%.

In preferred embodiments administration of a therapeutically effective amount of the nucleic acid, the composition, the polypeptide, the vaccine to a subject induces a neutralizing antibody titer against SARS-CoV-2 coronavirus in the subject.

In some embodiments, the neutralizing antibody titer is at least 100 neutralizing units per milliliter (NU/mL), at least 500 NU/mL, or at least 1000 NU/mL.

In some embodiments, detectable levels of the coronavirus antigen are produced in the subject at about 1 to about 72 hours post administration of the nucleic acid, the composition, the polypeptide, or the vaccine.

In some embodiments, a neutralizing antibody titer (against coronavirus) of at least 100 NU/ml, at least 500 NU/ml, or at least 1000 NU/ml is produced in the serum of the subject at about 1 day to about 72 days post administration of the nucleic acid, the composition, the polypeptide, or the vaccine.

In some embodiments, the neutralizing antibody titer is sufficient to reduce coronavirus infection by at least 50% relative to a neutralizing antibody titer of an unvaccinated control subject or relative to a neutralizing antibody titer of a subject vaccinated with a live attenuated viral vaccine, an inactivated viral vaccine, or a protein subunit viral vaccine.

In some embodiments, the neutralizing antibody titer and/or a T cell immune response is sufficient to reduce the rate of asymptomatic viral infection relative to the neutralizing antibody titer of unvaccinated control subjects.

In some embodiments, the neutralizing antibody titer and/or a T cell immune response is sufficient to prevent viral latency in the subject.

In some embodiments, the neutralizing antibody titer is sufficient to block fusion of virus with epithelial cells of the subject.

In some embodiments, the neutralizing antibody titer is induced within 20 days following a single 1 ug-100 ug dose of the nucleic acid, the composition, the polypeptide, or the vaccine, or within 40 days following a second 1 ug-100 ug dose of the nucleic acid, the composition, the polypeptide, or the vaccine.

In preferred embodiments, administration of a therapeutically effective amount of the nucleic acid, the composition, the polypeptide, or the vaccine to a subject induces a T cell immune response against coronavirus in the subject. In preferred embodiments, the T cell immune response comprises a CD4+ T cell immune response and/or a CD8+ T cell immune response.

Kit or Kit of Parts, Application, Medical Uses, Method of Treatment:

In a fourth aspect, the present invention provides a kit or kit of parts suitable for treating or preventing a coronavirus infection. Preferably, said kit or kit of parts is suitable for treating or preventing a coronavirus, preferably a SARS-CoV-2 (formerly nCoV-2019) coronavirus infection.

Notably, embodiments relating to the nucleic acid of the first aspect, the composition of the second aspect, the polypeptide of the third aspect, and the vaccine of the fourth aspect may likewise be read on and be understood as suitable embodiments of the kit or kit of parts of the fifth aspect of the invention.

In preferred embodiments, the kit or kit of parts comprises at least one nucleic acid (e.g. RNA or DNA), preferably at least one RNA of the first aspect, at least one composition of the second aspect, and/or at least one polypeptide of the third aspect, and/or at least one vaccine of the fourth aspect.

In embodiments, the kit or kit of parts comprises at least one DNA as defined in the first aspect, e.g. at least one plasmid DNA and/or at least one adenovirus DNA.

In embodiments, the kit or kit of parts comprises at least one polypeptide as defined in the third aspect.

In addition, the kit or kit of parts may comprise a liquid vehicle for solubilising, and/or technical instructions providing information on administration and dosage of the components.

The kit may further comprise additional components as described in the context of the composition of the second aspect, and/or the vaccine of the fourth aspect.

The technical instructions of said kit may contain information about administration and dosage and patient groups. Such kits, preferably kits of parts, may be applied e.g. for any of the applications or uses mentioned herein, preferably for the use of the nucleic acid of the first aspect, the composition of the second aspect, the polypeptide of the third aspect, or the vaccine of the fourth aspect, for the treatment or prophylaxis of an infection or diseases caused by a coronavirus, preferably SARS-CoV-2 coronavirus, or disorders related thereto.

Preferably, the nucleic acid, the composition, the polypeptide, or the vaccine is provided in a separate part of the kit, wherein the nucleic acid, the composition, the polypeptide, or the vaccine is preferably lyophilised.

The kit may further contain as a part a vehicle (e.g. buffer solution) for solubilising the nucleic acid, the composition, the polypeptide, or the vaccine.

In preferred embodiments, the kit or kit of parts as defined herein comprises Ringer lactate solution.

In preferred embodiments, the kit or kit of parts as defined herein comprises a multidose container for administration of the composition/the vaccine.

Any of the above kits may be used in a treatment or prophylaxis as defined herein. More preferably, any of the above kits may be used as a vaccine, preferably a vaccine against infections caused by a coronavirus, preferably caused by SARS-CoV-2 coronavirus.

In preferred embodiments, the kit or kit of parts comprises the following components:

a) at least one container or vial comprising a composition or SARS-CoV-2 vaccine as defined herein, wherein the composition or SARS-CoV-2 vaccine has a nucleic acid concentration, preferably an RNA concentration in a range of about 100 μg/ml to about 1 mg/ml, preferably in a range of about 100 μg/ml to about 500 μg/ml, e.g. about 270 μg/ml.

b) at least one dilution container or vial comprising a sterile dilution buffer, suitably a buffer comprising NaCl, optionally comprising a preservative;

c) at least one means for transferring the composition or vaccine from the storage container to the dilution container; and d) at least one syringe for administering the final diluted composition or vaccine to a subject, preferably configured for intramuscular administration to a human subject, wherein the final diluted composition or vaccine has a nucleic acid concentration, preferably an RNA concentration in a range of about 10 μg/ml to about 100 μg/ml, preferably in a range of about 10 μg/ml to about 50 μg/ml, e.g. about 24 μg/ml In an embodiment, the kit or kit of parts comprises more than one mRNA-based SARS-CoV-2 composition/vaccine, preferably at least one vaccine as defined herein provided in a first vial or container, wherein the vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 163, 149 or 24837, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid 111-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-28686, 28777-28825, 28925-28928, 28933-28936 preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or.

at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27394, 27417, 27486, 28762, 28650-28655, 28789-28794, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27394, 27417, 27486, 28762, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 28639-28642, 28778-28781, 28925-28928, 28933-28936 preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified In an embodiment, the kit or kit of parts comprises more than one mRNA-based SARS-CoV-2 composition/vaccine, preferably at least one vaccine as defined herein provided in a first vial or container, wherein the vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 163, 149 or 24837, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 24837-24854, 27524-27546, 24855-24872, 27547-27569, 24909-24926, 27616-27638, 28827-28866, 28687-28735, 28867-28915, 28929-28932, 28937-28940 preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27532, 27555, 27624, 28852, 28699-28704, 28879-28884, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 27532, 27555, 27624, 28852, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified; and/or at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 28688-28691, 28868-28871, 28929-28932, 28937-28940 preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified.

In an embodiment, the kit or kit of parts comprises two different SARS-CoV-2 vaccines for prime vaccination and boost vaccination:

at least one prime vaccine as defined herein provided in a first vial or container, wherein the vaccine is an mRNA-based SARS-CoV-2 vaccine as defined herein; and at least one boost vaccine as defined herein provided in a first vial or container, wherein the composition/vaccine is an adenovirus-based SARS-CoV-2 vaccine as defined herein.

In an embodiment, the kit or kit of parts comprises two different SARS-CoV-2 vaccines for prime vaccination and boost vaccination:

at least one boost vaccine as defined herein provided in a first vial or container, wherein the vaccine is an mRNA-based SARS-CoV-2 vaccine as defined herein; and at least one prime vaccine as defined herein provided in a first vial or container, wherein the composition/vaccine is an adenovirus-based SARS-CoV-2 vaccine as defined herein.

Combination:

A fifth aspect relates to a combination of at least two nucleic acid sequences as defined in the first aspect, at least two compositions as defined in the context of the second aspect, at least two polypeptides as defined in the third aspect, at least two vaccines as defined in the context of the fourth aspect, or at least two kits as defined in the fifth aspect.

In the context of the present invention, the term "combination" preferably means a combined occurrence of at least two components, preferably at least two nucleic acid sequences as defined in the first aspect, at least two compositions as defined in the context of the second aspect, at least two polypeptides as defined in the third aspect, at least two vaccines as defined in the context of the fourth aspect, or at least two kits as defined in the fifth aspect. The components of such a combination may occur as separate entities. Thus, the administration of the components of the combination may occur either simultaneously or timely staggered, either at the same site of administration or at different sites of administration.

Notably, embodiments relating to the nucleic acid of the first aspect, the composition of the second aspect, the polypeptide of the third aspect, and the vaccine of the fourth aspect, or the kit or kit of parts of the fifth aspect may likewise be read on and be understood as suitable embodiments of the components of the combination of the sixth aspect.

In embodiments, the combination may comprise a plurality or at least more than one of the nucleic acid species, e.g. RNA species as defined in the context of the first aspect of the invention, wherein the nucleic acid species are provided as separate components.

Preferably, the combination as defined herein may comprise 2, 3, 4, 5, 6, 7, 8, 9, or 10 or more different nucleic acids e.g. RNA species as defined in the context of the first aspect of the invention; 2, 3, 4, 5, 6, 7, 8, 9, or 10 different compositions as defined in the context of the second aspect of the invention; 2, 3, 4, 5, 6, 7, 8, 9, or 10 different polypeptides as defined in the context of the third aspect of the invention; 2, 3, 4, 5, 6, 7, 8, 9, or 10 different vaccines as defined in the context of the third aspect of the invention, wherein the nucleic acid species, compositions, polypeptides, vaccines are provided as separate components.

In embodiments, the combination comprises 2, 3, 4 or 5 RNAs comprised in separate components, preferably RNA species, wherein said nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 149, 22792, 22794, 22796, 22798, 22800, 22802, 22804, 22806, 22808, 22810, 22812, 23529-23534, 27386-27408, 23535-23552, 27409-27431, 23590-23606, 27478-27500, 28736-28776, 28638-28686, 28777-28825, 28925-28928, 28933-28936 and, optionally, at least one pharmaceutically acceptable carrier or excipient, wherein each of the 2, 3, 4 or 5 nucleic acid species encode a different antigenic peptide or protein of a SARS-CoV-2 coronavirus.

In embodiments, the combination comprises 2, 3, 4 or 5 RNAs comprised in separate components, preferably RNA species, wherein said nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 24837-24854, 27524-27546, 24855-24872, 27547-27569, 24909-24926, 27616-27638, 28827-28866, 28687-28735, 28867-28915, 28929-28932, 28937-28940 and, optionally, at least one pharmaceutically acceptable carrier or excipient, wherein each of the 2, 3, 4 or 5 nucleic acid species encode a different antigenic peptide or protein of a SARS-CoV-2 coronavirus.

In the following, particularly preferred embodiments of a combination are provided, wherein each component of the combination is provided as separate entities.

Preferably, the at least 2, 3, 4, 5, 6, 7, 8, 9, 10 or even more different nucleic acid species, compositions, vaccines of the combination each encode a different prefusion stabilized spike protein (as defined in the first aspect). Preferably, stabilization of the prefusion conformation is obtained by introducing two consecutive proline substitutions at residues K986 and V987 in the spike protein (Amino acid positions according to reference SEQ ID NO: 1). Accordingly, in preferred embodiments, the at least 2, 3, 4, 5, 6, 7, 8, 9, 10 pre-fusion stabilized spike proteins (S_stab) each comprises at least one pre-fusion stabilizing mutation, wherein the at least one pre-fusion stabilizing mutation comprises the following amino acid substitutions: K986P and V987P (amino acid positions according to reference SEQ ID NO: 1).

Accordingly, the at least 2, 3, 4, 5, 6, 7, 8, 9, 10 or even more different nucleic acid species, compositions, vaccines of the combination each encode a different prefusion stabilized spike protein, wherein the at least 2, 3, 4, 5, 6, 7, 8, 9, 10 or even more stabilized spike proteins are selected from amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, 22738, 22740, 22742, 22744, 22746, 22748, 22750, 22752, 22754, 22756, 22758, 22959-22964, 27087-27109, 28540-28588, 28917-28920 or an immunogenic fragment or immunogenic variant of any of these.

In preferred embodiments, the combination comprises one nucleic acid species, composition, vaccine comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, wherein the multivalent composition additionally comprises at least 2, 3, 4 further RNA species selected from i) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22961; and/or ii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960; and/or iii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22963; and/or iv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22959;

v) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27070, 27093;

vi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27071, 27094;

vii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27072, 27095;

viii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27073, 27096, 28545; and/or ix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22964.

x) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 28541-28544, 28917-28920.

Preferably, the at least 2, 3, 4, 5, 6, 7, 8, 9, 10 or even more different nucleic acid species, composition, vaccine of the combination comprise nucleic acid coding sequences each encoding a different prefusion stabilized spike protein, wherein the at least 2, 3, 4, 5, 6, 7, 8, 9, 10 or even more nucleic acid coding sequences are selected from nucleic acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 116, 136, 137, 146, 148, 149, 151, 162, 163, 165, 22765, 22767, 22769, 22771, 22773, 22775, 22777, 22779, 22781, 22783, 22785, 22792, 22794, 22796, 22798, 22800, 22802, 22804, 22806, 22808, 22810, 22812, 22819, 22821, 22823, 22825, 22827, 22829, 22831, 22833, 22835, 22837, 22839, 28916, 23089-23148, 23150-23184, 23309-23368, 23370-23404, 23529-23588, 23590-23624, 24837-24944, 27110-27907, 28589-28915, 28916, 28921-28940 or fragments or variants of any of these. Preferably, each of the mRNA species comprise a cap1 structure, and, optionally, each of the mRNA species do not comprise modified nucleotides.

In a specific embodiment, a first component of the combination comprises a viral vector vaccine/composition, such as an adenovirus vector based vaccine, e.g., ADZ1222 or Ad26.COV-2.S, and a second component comprises a nucleic acid based vaccine/composition, preferably an mRNA-based vaccine as defined herein.

First and Second/Further Medical Use:

A further aspect relates to the first medical use of the provided nucleic acid, composition, vaccine, kit, or combination.

Notably, embodiments relating to the nucleic acid of the first aspect, the composition of the second aspect, the polypeptide of the third aspect, and the vaccine of the fourth aspect, or the kit or kit of parts of the fifth aspect, or the combination may likewise be read on and be understood as suitable embodiments of medical uses of the invention.

Accordingly, the invention provides at least one nucleic acid (e.g. DNA or RNA), preferably RNA as defined in the first aspect for use as a medicament, the composition as defined in the second aspect for use as a medicament, the polypeptide as defined in the third aspect for use as a medicament, the vaccine as defined in the fourth aspect for use as a medicament, and the kit or kit of parts as defined in the fifth aspect for use as a medicament, and the combination.

The present invention furthermore provides several applications and uses of the nucleic acid, composition, polypeptide, vaccine, or kit, or combination.

In particular, nucleic acid (preferably RNA), composition, polypeptide, vaccine, or kit, or combination may be used for human medical purposes and also for veterinary medical purposes, preferably for human medical purposes.

In particular, nucleic acid (preferably RNA), composition, polypeptide, vaccine, or kit or kit of parts or combination is for use as a medicament for human medical purposes, wherein said nucleic acid (preferably RNA), composition, polypeptide, vaccine, or kit or kit of parts may be suitable for young infants, newborns, immunocompromised recipients, as well as pregnant and breast-feeding women and elderly people. In particular, nucleic acid (preferably RNA), composition, polypeptide, vaccine, or kit or kit of parts is for use as a medicament for human medical purposes, wherein said nucleic acid (preferably RNA), composition, polypeptide, vaccine, or kit or kit of parts is particularly suitable for elderly human subjects.

Said nucleic acid (preferably RNA), composition, polypeptide, vaccine, or kit or combination is for use as a medicament for human medical purposes, wherein said RNA, composition, vaccine, or the kit or kit of parts may be particularly suitable for intramuscular injection or intradermal injection.

In yet another aspect, the invention relates to the second medical use of the provided nucleic acid, composition, polypeptide, vaccine, or kit or combination.

Accordingly, the invention provides at least one nucleic acid, preferably RNA as defined in the first aspect for treatment or prophylaxis of an infection with a coronavirus, preferably SARS-CoV-2 coronavirus, or a disorder or a disease related to such an infection, such as COVID-19; a composition as defined in the second aspect for treatment or prophylaxis of an infection with a coronavirus, preferably SARS-CoV-2 coronavirus, or a disorder or a disease related to such an infection, such as COVID-19; a polypeptide as defined in the third aspect for treatment or prophylaxis of an infection with a coronavirus, preferably SARS-CoV-2 coronavirus, or a disorder or a disease related to such an infection, such as COVID-19; a vaccine as defined in the fourth aspect for treatment or prophylaxis of an infection with a coronavirus, preferably SARS-CoV-2 coronavirus, or a disorder or a disease related to such an infection, such as COVID-19; a kit or kit of parts as defined in the fifth aspect for treatment or prophylaxis of an infection with a coronavirus, preferably SARS-CoV-2 coronavirus, or a disorder or a disease related to such an infection, such as COVID-19; a combination as defined in the sixth aspect for treatment or prophylaxis of an infection with a coronavirus, preferably SARS-CoV-2 coronavirus, or a disorder or a disease related to such an infection, such as COVID-19.

In embodiments, the nucleic acid, preferably RNA of the first aspect, the composition of the second aspect, the polypeptide of the third aspect, the vaccine of the fourth aspect, or the kit or kit of parts of the fifth aspect, or the combination of the sixth aspect, is for use in the treatment or prophylaxis of an infection with a coronavirus, preferably with SARS-CoV-2 coronavirus.

Particularly, the nucleic acid, preferably RNA of the first aspect, the composition of the second aspect, the polypeptide of the third aspect, the vaccine of the fourth aspect, or the kit or kit of parts of the fifth aspect, or the combination of the sixth aspect, may be used in a method of prophylactic (pre-exposure prophylaxis or post-exposure prophylaxis) and/or therapeutic treatment of infections caused by a coronavirus, preferably SARS-CoV-2 coronavirus.

Particularly, the nucleic acid, preferably RNA of the first aspect, the composition of the second aspect, the polypeptide of the third aspect, the vaccine of the fourth aspect, or the kit or kit of parts of the fifth aspect, or the combination of the sixth aspect, may be used in a method of prophylactic (pre-exposure prophylaxis or post-exposure prophylaxis) and/or therapeutic treatment of COVID-19 disease caused by a SARS-CoV-2 coronavirus infection.

The nucleic acid, the composition, the polypeptide, or the vaccine, or the combination may preferably be administered locally. In particular, composition or polypeptides or vaccines or combinations may be administered by an intradermal, subcutaneous, intranasal, or intramuscular route. In embodiments, the inventive nucleic acid, composition, polypeptide, vaccine may be administered by conventional needle injection or needle-free jet injection. Preferred in that context is intramuscular injection.

In embodiments where plasmid DNA is used and comprised in the composition or vaccine or combination, the composition/vaccine/combination may be administered by electroporation using an electroporation device, e.g. an electroporation device for intradermal or intramuscular delivery. Suitably, a device as described in U.S. Pat. No. 7,245,963B2 may be used, in particular a device as defined by claims 1 to 68 of U.S. Pat. No. 7,245,963B2.

In embodiments where adenovirus DNA is used and comprised in the composition or vaccine or combination, the composition/vaccine/combination may be administered by intranasal administration.

In embodiments, the nucleic acid as comprised in a composition or vaccine or combination as defined herein is provided in an amount of about 100 ng to about 500 ug, in an amount of about 1 ug to about 200 ug, in an amount of about 1 ug to about 100 ug, in an amount of about 5 ug to about 100 ug, preferably in an amount of about 1 ug to about 50 ug, specifically, in an amount of about 1 ug, 2 ug, 3 ug, 4 ug, 5 ug, 8 ug, 9 ug, 10 ug, 11 ug, 12 ug, 13 ug, 14 ug, 15 ug, 16 ug 20 ug, 25 ug, 30 ug, 35 ug, 40 ug, 45 ug, 50 ug, 55 ug, 60 ug, 65 ug, 70 ug, 75 ug, 80 ug, 85 ug, 90 ug, 95 ug or 100 ug.

In some embodiments, the vaccine comprising the nucleic acid, or the composition comprising the nucleic acid is formulated in an effective amount to produce an antigen specific immune response in a subject. In some embodiments, the effective amount of nucleic acid is a total dose of 1 ug to 200 ug, 1 ug to 100 ug, or 5 ug to 100 ug.

In embodiments where the nucleic acid is provided in a lipid-based carrier, e.g. an LNP, the amount of PEG-lipid as defined herein comprised in one dose is lower than about 50 µg PEG lipid, preferably lower than about 45 µg PEG lipid, more preferably lower than about 40 µg PEG lipid.

Having a low amount of PEG lipid in one dose may reduce the risk of adverse effects (e.g. allergies).

In particularly preferred embodiments, the amount of PEG-lipid comprised in one dose is in a range from about 3.5 µg PEG lipid to about 35 µg PEG lipid.

In embodiments where the nucleic acid is provided in a lipid-based carrier, e.g. an LNP, the amount of cationic lipid as defined herein comprised in one dose is lower than about 400 µg cationic lipid, preferably lower than about 350 µg cationic lipid, more preferably lower than about 300 µg cationic lipid.

Having a low amount of cationic lipid in one dose may reduce the risk of adverse effects (e.g. fewer).

In particularly preferred embodiments, the amount of cationic-lipid comprised in one dose is in a range from about 30 µg PEG lipid to about 300 µg PEG lipid.

In one embodiment, the immunization protocol for the treatment or prophylaxis of a subject against coronavirus, preferably SARS-CoV-2 coronavirus comprises one single doses of the composition or the vaccine.

In some embodiments, the effective amount is a dose of 1 ug administered to the subject in one vaccination. In some embodiments, the effective amount is a dose of 2 ug administered to the subject in one vaccination. In some embodiments, the effective amount is a dose of 3 ug administered to the subject in one vaccination. In some embodiments, the effective amount is a dose of 4 ug administered to the subject in one vaccination. In some embodiments, the effective amount is a dose of 5 ug administered to the subject in one vaccination. 6 ug administered to the subject in one vaccination. In some embodiments, the effective amount is a dose of 7 ug administered to the subject in one vaccination. In some embodiments, the effective amount is a dose of 8 ug administered to the subject in one vaccination. In some embodiments, the effective amount is a dose of 9 ug administered to the subject in one vaccination. In some embodiments, the effective amount is a dose of 10 ug administered to the subject in one vaccination. In some embodiments, the effective amount is a dose of 11 ug administered to the subject in one vaccination. In some embodiments, the effective amount is a dose of 12 ug administered to the subject in one vaccination. In some embodiments, the effective amount is a dose of 13 ug administered to the subject in one vaccination. In some embodiments, the effective amount is a dose of 14 ug administered to the subject in one vaccination. In some embodiments, the effective amount is a dose of 16 ug administered to the subject in one vaccination. In some embodiments, the effective amount is a dose of 20 ug administered to the subject in one vaccination. In some embodiments, the effective amount is a dose of 25 ug administered to the subject in one vaccination. In some embodiments, the effective amount is a dose of 30 ug administered to the subject in one vaccination. In some embodiments, the effective amount is a dose of 40 ug administered to the subject in one vaccination. In some embodiments, the effective amount is a dose of 50 ug administered to the subject in one vaccination. In some embodiments, the effective amount is a dose of 100 ug administered to the subject in one vaccination. In some embodiments, the effective amount is a dose of 200 ug administered to the subject in one vaccination. A "dose" in that context relates to the effective amount of nucleic acid, preferably mRNA as defined herein.

In preferred embodiments, the immunization protocol for the treatment or prophylaxis of a coronavirus, preferably a SARS-CoV-2 coronavirus infection comprises a series of single doses or dosages of the composition or the vaccine. A single dosage, as used herein, refers to the initial/first dose, a second dose or any further doses, respectively, which are preferably administered in order to "boost" the immune reaction.

In some embodiments, the effective amount is a dose of 1 ug administered to the subject a total of two times. In some embodiments, the effective amount is a dose of 2 ug administered to the subject a total of two times. In some embodiments, the effective amount is a dose of 3 ug administered to the subject a total of two times. In some embodiments, the effective amount is a dose of 4 ug administered to the subject a total of two times. In some embodiments, the effective amount is a dose of 5 ug administered to the subject a total of two times. In some embodiments, the effective amount is a dose of 6 ug administered to the subject a total of two times. In some embodiments, the effective amount is a dose of 7 ug administered to the subject a total of two times. In some embodiments, the effective amount is a dose of 8 ug administered to the subject a total of two times. In some embodiments, the effective amount is a dose of 9 ug administered to the subject a total of two times. In some embodiments, the effective amount is a dose of 10 ug administered to the subject a total of two times. In some embodiments, the effective amount is a dose of 11 ug administered to the subject a total of two times. In some embodiments, the effective amount is a dose of 12 ug administered to the subject a total of two times. In some embodiments, the effective amount is a dose of 13 ug administered to the subject a total of two times. In some embodiments, the effective amount is a dose of 14 ug administered to the subject a total of two times. In some embodiments, the effective amount is a dose of 16 ug administered to the subject a total of two times. In some embodiments, the effective amount is a dose of 20 ug administered to the subject a total of two times. In some embodiments, the effective amount is a dose of 25 ug administered to the subject a total of two times. In some embodiments, the effective amount is a dose of 30 ug administered to the subject a total of two times. In some embodiments, the effective amount is a dose of 40 ug administered to the subject a total of two times. In some embodiments, the effective amount is a dose of 50 ug administered to the subject a total of two times. In some embodiments, the effective amount is a dose of 100 ug administered to the subject a total of two times. In some embodiments, the effective amount is a dose of 200 ug administered to the subject a total of two times. A "dose" in that context relates to the effective amount of nucleic acid, preferably mRNA as defined herein.

In preferred embodiments, the vaccine/composition/combination immunizes the subject against a coronavirus, preferably against a SARS-CoV-2 coronavirus infection (upon administration as defined herein) for at least 1 year, preferably at least 2 years. In preferred embodiments, the vaccine/composition/combination immunizes the subject against a coronavirus, preferably against a SARS-CoV-2 coronavirus for more than 2 years, more preferably for more than 3 years, even more preferably for more than 4 years, even more preferably for more than 5-10 years.

Method of Treatment and Use, Diagnostic Method and Use:

In another aspect, the present invention relates to a method of treating or preventing a disorder.

Notably, embodiments relating to the nucleic acid of the first aspect, the composition of the second aspect, the polypeptide of the third aspect, and the vaccine of the fourth aspect, the kit or kit of parts of the fifth aspect, the combination of the sixth aspect, or medical uses may likewise be read on and be understood as suitable embodiments of methods of treatments as provided herein. Furthermore, specific features and embodiments relating to method of treatments as provided herein may also apply for medical uses of the invention.

Preventing (Inhibiting) or treating a disease, in particular a coronavirus infection relates to inhibiting the full development of a disease or condition, for example, in a subject who is at risk for a disease such as a coronavirus infection. "Treatment" refers to a therapeutic intervention that ameliorates a sign or symptom of a disease or pathological condition after it has begun to develop. The term "ameliorating", with reference to a disease or pathological condition, refers to any observable beneficial effect of the treatment. Inhibiting a disease can include preventing or reducing the risk of the disease, such as preventing or reducing the risk of viral infection. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters that are specific to the particular disease. A "prophylactic" treatment is a treatment administered to a subject who does not exhibit signs of a disease or exhibits only early signs for the purpose of decreasing the risk of developing pathology.

In preferred embodiments, the present invention relates to a method of treating or preventing a disorder, wherein the method comprises applying or administering to a subject in need thereof at least one nucleic acid of the first aspect, the composition of the second aspect, the polypeptide of the third aspect, the vaccine of the fourth aspect, or the kit or kit of parts of the fifth aspect, or the combination of the sixth aspect.

In preferred embodiments, the disorder is an infection with a coronavirus, or a disorder related to such infections, in particular an infection with SARS-CoV-2 coronavirus, or a disorder related to such infections, e.g. COVID-19.

In preferred embodiments, the present invention relates to a method of treating or preventing a disorder as defined above, wherein the method comprises applying or administering to a subject in need thereof at least one nucleic acid of the first aspect, the composition of the second aspect, the polypeptide of the third aspect, the vaccine of the fourth aspect, or the kit or kit of parts of the fifth aspect, or the combination of the sixth aspect, wherein the subject in need is preferably a mammalian subject.

In certain embodiments, a method of treating or preventing disease by applying or administering to a subject in need thereof at least one nucleic acid of the first aspect, the composition of the second aspect, the polypeptide of the third aspect, the vaccine of the fourth aspect, or the kit or kit of parts of the fifth aspect or the combination of the sixth aspect, is further defined as a method of reducing disease burden in the subject. For example, the method preferably reduces the severity and/or duration of one or more symptom of COVID-19 disease. In some aspects, a method reduces the probability that a subject will require hospital admission, intensive care unit admission, treatment with supplemental oxygen and/or treatment with a ventilator. In further aspects, the method reduces the probability that a subject will develop a fever, breathing difficulties; loss of smell and/or loss of taste. In preferred aspects, the method reduces the probability that a subject will develop severe or moderate COVID-19 disease. In certain aspects, a method of the embodiments prevents severe or moderate COVID-19 disease in the subject between about 2 weeks and 1 month, 2 months, 3 months, 4 months, 5 months, 6 months, 1 year or 2 years after the subject is administered a composition of the embodiments. In preferred aspects, a method of the embodiments prevents symptomatic COVID-19 disease. In further aspects, a method of the embodiment prevents detectable levels of SARS-CoV-2 nucleic acid in the subject between about 2 weeks and 1 month, 2 months, 3 months, 4 months, 5 months, 6 months, 1 year or 2 years after the subject is administered a composition of the embodiments. In further aspects, a method of the embodiments is defined as a method for providing protective immunity to a coronavirus infection (e.g., SARS-CoV-2 infection) in the subject. In still further aspects, a method of the embodiments prevents moderate and severe COVID-19 disease in at least 80%, 85%, 90% or 95% of treated subjects. In yet further aspects, a method of the embodiments prevents moderate and severe COVID-19 disease in at least 80%, 85%, 90% or 95% of treated subjects from about 2 weeks to about 1 year after administering the second or subsequent immunogenic composition (e.g., a booster administration). In yet further aspects, a method of the embodiments prevents moderate and severe COVID-19 disease in at least 80%, 85%, 90% or 95% of treated subjects from about 2 weeks to about 3 month, 6 months, 9 months, 1 year, 1.5 years, 2 years or 3 years after administering the second or subsequent composition.

In a further aspects, a method of the embodiments comprises (i) obtaining a composition (e.g., a vaccine composition) of the embodiments, wherein the composition is lyophilized; (ii) solubilizing the lyophilized composition in a pharmaceutically acceptable liquid carrier to produce a liquid composition; and (iii) administering an effective amount of the liquid composition to the subject. In some aspects, the lyophilized composition comprises less than about 10% water content. For example, the lyophilized composition can preferably comprise about 0.1% to about 10%, 0.5% to 7.5% or 0.5% to 5.0% water.

In still further aspects, a method of the embodiments comprises administering a vaccine composition comprising at least two different mRNAs, each mRNA encoding a different SARS-CoV-2 spike polypeptide that are each at least about 95% identical to SEQ ID NO: 10 (e.g., in complex with a LNP) to a subject. In further aspects, such a method provides a sufficient immune response in the subject to protect the subject from severe COVID-19 disease for at least about 6 months. For example, in some aspects, the subject is protected from severe COVID-19 disease for about 6 months to about 1 year, 1.5 years, 2 years, 2.5 years, 3 years, 4 years or 5 years. Thus, in some aspects, a method of the embodiments provides a single dose vaccine composition that can provide prolonged (e.g., greater than 6 months of) protection from severe disease to a subject.

As used herein severe COVID-19 disease is defined as a subject experiencing one or more of the following:

Clinical signs at rest indicative of severe systemic illness (respiratory rate ≥30 breaths per minute, heart rate ≥125 per minute, SpO2≤93% on room air at sea level or PaO2/FIO2<300 mm Hg (adjusted according to altitude))

Respiratory failure (defined as needing high flow-oxygen, noninvasive ventilation, mechanical ventilation or ECMO)

Evidence of shock (SBP<90 mm Hg, DBP<60 mmHg, or requiring vasopressors)

Significant renal, hepatic, or neurologic dysfunction

Admission to ICU

Death

As used herein moderate COVID-19 disease is defined as a subject experiencing one or more of the following:

Shortness of breath or difficulty breathing

Respiratory rate ≥20 breaths per minute

Abnormal SpO2 but still >93% on room air at sea level (adjusted according to altitude)

Clinical or radiographic evidence of lower respiratory tract disease

Radiologic evidence of deep vein thrombosis (DVT)

As used herein mild COVID-19 disease is defined as a subject experiencing all of the following:

Symptomatic AND

No shortness of breath or difficulty breathing AND

No hypoxemia (adjusted according to altitude) AND

Does not meet the case definition of moderate or severe COVID-19 disease

In particularly preferred embodiments, the subject in need is a mammalian subject, preferably a human subject, e.g. newborn, pregnant, immunocompromised, and/or elderly. In some embodiments, the subject between the ages of 6 months and 100 years, 6 months and 80 years, 1 year and 80 years, 1 year and 70 years, 2 years and 80 years or 2 years and 60 years. In other embodiments the subject is a newborn or infant of an age of not more than 3 years, of not more than 2 years, of not more than 1.5 years, of not more than 1 year (12 months), of not more than 9 months, 6 months or 3 months. In certain embodiments, the human subject is an elderly human subject. In some other embodiments the subject is an elderly subject of an age of at least 50, 60, 65, or 70 years. In further aspects, a subject for treatment according to the embodiments is 61 years of age or older. In still further aspects, the subject is 18 years old to 60 years old.

In further embodiments, the mammalian subject is a human subject is 60 years of age or less. In certain embodiments the human subject is human subject is 55, 50, 45 or 40 years of age or less. Thus, in some embodiments, is the human subject is between about 12 and 60; 12 and 55; 12 and 50; 12 and 45; or 12 and 40 years of age. In further embodiments the human subject is between about 18 and 60; 18 and 55; 18 and 50; 18 and 45; or 18 and 40 years of age. In some embodiments the human subject is 18 to 50 or 18 to 40 years of age.

In certain embodiments, a subject for treatment according to the embodiments is a pregnant subject, such a pregnant human. In some aspects, the subject has been pregnant for more than about one month, two months, three months, four months, five months, six months, seven months or eight months.

In certain aspects, a subject for treatment according to the embodiments has native American, African, Asian or European heritage. In some aspects, the subject has at least about 10%, 15%, 20%, 25%, 30%, 35%, 40%, 45%, 50%, 55%, 60%, 65%, 70%, 75%, 80%, 85% or 90% native American, African, Asian or European heritage. In certain aspects, the subject has native American heritage, such as at least about 10%, 25% or 50% native American heritage. In further aspects, the subject is an elderly subject having native American heritage, e.g., a subject who is at least 55, 60, 65 or 70 years of age.

In further aspects, a subject for treatment according to the embodiments has a disease or is immune compromised. In some aspects, the subject has liver disease, kidney disease diabetes, hypertension, heart disease or lung disease. In further aspects, a subject for treatment according to the embodiments is a subject with history of allergic reaction, such a subject having food allergies. In some aspect, the subject has had a previous allergic reaction to a vaccine, such as an anaphylactic reaction. In still further aspects, a subject for treatment according to the methods is a subject having detectable anti-PEG antibodies, such as detectable anti-PEG IgE in the serum.

In further aspects, a subject for treatment according to the embodiments has at least one co-morbidity selected from:

(i) Chronic kidney disease: Kidney function will be ascertained from the serum creatinine measurement within the last 3-6 months, converted into estimated glomerular filtration rate (eGFR) using the Chronic Kidney Disease Epidemiology Collaboration (CKD-EPI) equation, with impaired kidney function defined as eGFR <60 mL/min/1.73 $m^2$.

Mild chronic kidney disease is defined as an eGFR between 60-89 mL/min/1.73 $m^2$.

Moderate chronic kidney disease is defined as an eGFR between 31-59 mL/min/1.73 $m^2$ with stable therapy and good maintenance over at least 6 months (modified from Clinical Practice Clinical Guidelines for Chronic Kidney Disease: Am J Kidney Dis, 2002).

(ii) COPD (including emphysema and chronic bronchitis).

Mild COPD with or without cough or sputum production is defined as forced expiratory volume in 1 second/forced vital capacity (FEV1/FVC)<0.7 and FEV1≥80% predicted.

Moderate COPD with or without cough or sputum production is defined as FEV1/FVC <0.7 and FEV1 ≥50%, but <80% predicted with stable treatment (GOLD Criteria for COPD severity).

(iii) Obesity with body mass index (BMI) of >32 kg/$m^2$—any extreme morbid obesity will also be included.

(iv) Chronic cardiovascular conditions (heart failure, coronary artery disease, cardiomyopathies, arterial hypertension), including the following:

Class I heart failure with potential high risk for developing heart failure in future with no functional or structural heart disorder.

Class II heart failure: subjects with cardiac disease resulting in slight limitation of physical activity. Comfortable at rest.

Ordinary physical activity results in fatigue, palpitation, dyspnea, or anginal pain.

Class III heart failure with marked limitation of physical activity, but comfortable at rest but less than ordinary activity results in symptoms.

A structural heart disorder without symptoms at any stage.

Mild left ventricular systolic or diastolic dysfunction, usually with not much produced clinical signs.

Moderate left ventricular failure with exertional dyspnea or orthopnea or paroxysmal nocturnal dyspnea as per New York Heart Association (NYHA), stable with medication (Class II-III).

Coronary artery disease of 2 and above metabolic equivalent threshold (MET) up to moderate, stable with medication. (MET is defined as the amount of oxygen consumed while sitting at rest and is equal to 3.5 ml $O_2$ per kg body weight×min; 4 Normal, can climb a flight of stairs or walk up a hill and can participate in other strenuous activities; 1 can take care of him/herself and may not maintain themselves and gets constraints on exertion.)

Cardiomyopathies of non-infective and metabolic origin of 2-3 MET with medication.

Stage 1 hypertension or Stage 2 hypertension stable and controlled with medications.

(v) Chronic HIV infection with stable aviraemia (<50 copies/mL) and CD4 count >350/mL as documented by blood samples taken within 12 months before enrolment. (Viral load <50 copies/mL with transient changes of 50-350 copies/mL is allowed.)

(vi) Type 2 diabetes mellitus, either controlled with medication [hemoglobin A1c (HbA1c)<58 mmol/mol (7.45%)] or uncontrolled with recent HbA1c of >58 mmol/mol (7.45%); [(HbA1c in % −2.15)×10.929=HbA1c in mmol/mol]; in uncontrolled DM HbA1c should be within <10% variation and should not have any history of diabetic ketoacidosis or episode of severe symptomatic hypoglycemia within prior 3 months.

(vii) Subjects who underwent renal transplant at least a year ago under stable conditions for at least 6 months with medications, categorized as low risk of rejection.

In still further aspects, a subject for treatment according to the embodiments has not been treated with an immunosuppressant drug for more than 14 days in the last 6 months. In some aspects, a subject for treatment according to the embodiments has not received a live vaccine for at least 28 days prior to the administration and/or has not received an inactivated vaccine for at least 14 days prior to the administration. In further aspects a subject for treatment according to the embodiments has NOT:

Had virologically-confirmed COVID-19 illness;

For females: experienced pregnancy or lactation with-in a month prior to administration of the composition of the embodiments;

had treatment with an investigational or non-registered product (e.g., vaccine or drug) within 28 days preceding the administration of the composition of the embodiments;

received a licensed vaccines within 28 days (for live vaccines) or 14 days (for inactivated vaccines) prior to the administration of the composition of the embodiments;

been previously or concurrently treated with any investigational SARS-CoV-2 vaccine or another coronavirus (SARS-CoV, MERS-CoV) vaccine;

been treated with immunosuppressants or other immune-modifying drugs (e.g., corticosteroids, biologicals and methotrexate) for >14 days total within 6 months preceding the administration of the composition of the embodiments;

had any medically diagnosed or suspected immunosuppressive or immunodeficient condition based on medical history and physical examination including known infection with human immunodeficiency virus (HIV), hepatitis B virus (HBV) or hepatitis C virus (HCV); current diagnosis of or treatment for cancer including leukemia, lymphoma, Hodgkin disease, multiple myeloma, or generalized malignancy; chronic renal failure or nephrotic syndrome; and receipt of an organ or bone marrow transplant.

had a history of angioedema (hereditary or idiopathic), or history of any anaphylactic reaction or pIMD.

a history of allergy to any component of CVnCoV vaccine.

been administered of immunoglobulins or any blood products within 3 months prior to the administration of the composition of the embodiments;

experienced a significant acute or chronic medical or psychiatric illness; and/or experienced severe and/or uncontrolled cardiovascular disease, gastrointestinal disease, liver disease, renal disease, respiratory disease, endocrine disorder, and neurological and psychiatric illnesses.

In certain aspects, a subject for treatment according to the methods of the embodiments does not have any potential immune-mediated disease (pIMD). In further aspects, a treatment method of the embodiments does not induce any pIMD in a treated subject. As used herein pIMDs are defined as Celiac disease; Crohn's disease; Ulcerative colitis; Ulcerative proctitis; Autoimmune cholangitis; Autoimmune hepatitis; Primary biliary cirrhosis; Primary sclerosing cholangitis; Addison's disease; Autoimmune thyroiditis (including Hashimoto thyroiditis; Diabetes mellitus type I; Grave's or Basedow's disease; Antisynthetase syndrome; Dermatomyositis; Juvenile chronic arthritis (including Still's disease); Mixed connective tissue disorder; Polymyalgia rheumatic; Polymyositis; Psoriatic arthropathy; Relapsing polychondritis; Rheumatoid arthritis; Scleroderma, (e.g., including diffuse systemic form and CREST syndrome); Spondyloarthritis, (e.g., including ankylosing spondylitis, reactive arthritis (Reiter's Syndrome) and undifferentiated spondyloarthritis); Systemic lupus erythematosus; Systemic sclerosis; Acute disseminated encephalomyelitis, (including site specific variants (e.g., non-infectious encephalitis, encephalomyelitis, myelitis, myeloradiculomyelitis)); Cranial nerve disorders, (e.g., including paralyses/paresis (e.g., Bell's palsy)); Guillain-Barré syndrome, (e.g., including Miller Fisher syndrome and other variants); Immune-mediated peripheral neuropathies, Parsonage-Turner syndrome and plexopathies, (e.g., including chronic inflammatory demyelinating polyneuropathy, multifocal motor neuropathy, and polyneuropathies associated with monoclonal gammopathy); Multiple sclerosis; Narcolepsy; Optic neuritis; Transverse Myelitis; Alopecia areata; Autoimmune bullous skin diseases, including pemphigus, pemphigoid and dermatitis herpetiformis; Cutaneous lupus erythematosus; Erythema nodosum; Morphoea; Lichen planus; Psoriasis; Sweet's syndrome; Vitiligo; Large vessels vasculitis (e.g., including: giant cell arteritis such as Takayasu's arteritis and temporal arteritis); Medium sized and/or small vessels vasculitis (e.g., including: polyarteritis nodosa, Kawasaki's disease, microscopic polyangiitis, Wegener's granulomatosis, Churg-Strauss syndrome (allergic granulomatous angiitis), Buerger's disease thromboangiitis obliterans, necrotizing vasculitis and anti-neutrophil cytoplasmic antibody (ANCA) positive vasculitis (type unspecified), Henoch-Schonlein purpura, Behcet's syndrome, leukocytoclastic vasculitis); Antiphospholipid syndrome; Autoimmune hemolytic anemia; Autoimmune glomerulonephritis (including IgA nephropathy, glomerulonephritis rapidly progressive, membranous glomerulonephritis, membranoproliferative glomerulonephritis, and mesangioproliferative glomerulonephritis); Autoimmune myocarditis/cardiomyopathy; Autoimmune thrombocytopenia; Goodpasture syndrome; Idiopathic pulmonary fibrosis; Pernicious anemia; Raynaudvs phenomenon; Sarcoidosis; Sjögren's syndrome; Stevens-Johnson syndrome; Uveitis).

In certain aspects, a vaccination method of the embodiments does not result in a subject experiencing any adverse events of special interest (AESIs). As used herein AESIs are defined as a pIMD listed above; Anaphylaxis; Vasculitides; Enhanced disease following immunization; Multisystem inflammatory syndrome in children; Acute Respiratory Distress Syndrome; COVID-19 disease; Acute cardiac injury; Microangiopathy; Heart failure and cardiogenic shock; Stress cardiomyopathy; Coronary artery disease; Arrhythmia; Myocarditis, pericarditis; Thrombocytopenia; Deep vein thrombosis; Pulmonary embolus; Cerebrovascular stroke; Limb ischemia; Hemorrhagic disease; Acute kidney injury; Liver injury; Generalized convulsion; Guillain-Barré Syndrome; Acute disseminated encephalomyelitis; Anosmia, ageusia; Meningoencephalitis; Chilblain-like lesions; Single organ cutaneous vasculitis; Erythema multiforme; Serious local/systemic AR following immunization In particular, such the method of treatment may comprise the steps of:

a) providing at least one nucleic acid (e.g. DNA or RNA), preferably at least one RNA of the first aspect, at least one composition of the second aspect, at least one polypeptide of the third aspect, at least one vaccine of the fourth aspect, or the kit or kit of parts of the fifth aspect;
b) applying or administering said nucleic acid, composition, polypeptide, vaccine, or kit or kit of parts to a subject as a first dose
c) optionally, applying or administering said nucleic acid, composition, polypeptide, vaccine, or kit or kit of parts to a subject as a second dose or a further dose, preferably at least 3, 4, 5, 6, 7, 8, 9, 10, 11, 12, months after the first dose.

The first dosage, as used herein, refers to the initial/first dose, a second dose or any further doses, respectively, which are preferably administered in order to "boost" the immune reaction. In certain aspects, the vaccine/composition is administered to a subject one, two three, four or more times. In some aspects, the vaccine/composition is administered to the subject at least first and a second time (e.g., a prime and boost). I some aspects, the send administration is at least 10 days, 14 days, 21 days, 28 days, 35 days, 42 days, 49 days or 56 days after the first administration. In some aspects, the time between the first administration and the second administration is between about 7 days and about 56 days; about 14 days and about 56 days; about 21 days and about 56 days; or about 28 days and about 56 days. In further aspects, the vaccine/composition is administered to a subject three or more times. In certain aspects, there is at least 10 days, 14 days, 21 days, 28 days, 35 days, 42 days, 49 days or 56 days between each administration of the vaccine/composition.

In some aspects, a subject for treatment according to the embodiments was previously infected with SARS-CoV-2 or was previously treated with at least a first SARS-CoV-2 vaccine composition. In some aspects, the subject was treated with one, two, three or more doses of a first SARS-CoV-2 vaccine composition. In some aspects, the composition of the embodiments used to treat a subject is a different type of vaccine composition than the composition previously used to treat the subject. In some aspects, the subject was previously treated with a mRNA vaccine, such as BNT162 or mRNA-1273. In further aspects, the subject was previously treated with a protein subunit vaccine, such as spike protein based vaccine, e.g., NVX-CoV2373 or COVAX. In certain preferred aspects, protein subunit vaccine compositions comprise an adjuvant. In further aspects, the subject was previously treated with a viral vector vaccine, such as an adenovirus vector based vaccine, e.g., ADZ1222 or Ad26.COV-2.S. In still further aspects, the subject was previously treated with an inactivated virus vaccine to SARS-CoV-2 such as CoronaVac, BBIBP-CorV or BBV152. In further aspects, a subject previously treated with a vaccine composition has detectable SARS-CoV-2 binding antibodies, such as SARS-CoV-2 S protein-binding antibodies or SARS-CoV-2 N protein-binding antibodies. In further aspects, a subject for treatment according the embodiments was treated with a first SARS-CoV-2 vaccine composition at least about 3 month, 6 months, 9 months, 1 year, 1.5 years, 2 years or 3 years ago. In still further aspects, a subject for treatment according the embodiments was treated with a first SARS-CoV-2 vaccine composition between about 3 months and 2 years ago or between about 6 months and 2 years ago. In some aspects, a subjects treated with a further vaccine composition of the embodiments are protected from moderate and severe COVID-19 disease in at least 80%, 85%, 90% or 95% of treated subjects. For example, the treated subjects can be protected from moderate and severe COVID-19 disease in at least 80%, 85%, 90% or 95% of treated subjects from about 2 weeks to about 1 year after administration of the further composition. In still further aspects, administering the further vaccine composition of the embodiments prevents moderate and severe COVID-19 disease in at least 80%, 85%, 90% or 95% of treated subjects from about 2 weeks to about 3 month, 6 months, 9 months, 1 year, 1.5 years, 2 years or 3 years after said administration. Examples of such combination vaccination strategies are shown below:

Dose 1 mRNA vaccine-T1-dose 2 mRNA vaccine-T2-dose 3 mRNA vaccine

Dose 1 mRNA vaccine-T1-dose 2 mRNA vaccine-T2-dose 3 protein subunit vaccine

Dose 1 mRNA vaccine-T1-dose 2 mRNA vaccine-T2-dose 3 viral vector vaccine

Dose 1 mRNA vaccine-T1-dose 2 mRNA vaccine-T2-dose 3 inactivated virus vaccine

Dose 1 protein subunit vaccine-T1-dose 2 protein subunit vaccine-T2-dose 3 mRNA vaccine Dose 1 inactivated virus vaccine-T1-dose 2 inactivated virus vaccine-T2-dose 3 mRNA vaccine Dose 1 viral vector vaccine-T1-dose 2 viral vector vaccine-T2-dose 3 mRNA vaccine Dose 1 viral vector vaccine-T2-dose 2 mRNA vaccine Dose 1 protein subunit vaccine-T2-dose 2 mRNA vaccine Dose 1 inactivated virus vaccine-T2-dose 2 mRNA vaccine Dose 1 mRNA vaccine-T2-dose 2 mRNA vaccine In the examples, above time period 1 (T1) is typically 2 to 6 weeks, preferably 3 to 4 weeks. Time period 2 (T2) is in some cases, about 3 months, 6 months, 9 months, 1 year, 1.5 years, 2 years or three years.

In some aspects, a method of the embodiments comprises administering multiple doses of a vaccine composition to a subject. In a further aspect, there is provided a method of reducing reactogenicity of a SARS-CoV-2 booster vaccine composition. In some aspects, after an initial vaccination, subject exhibiting a high level of reactogenicity are administered a booster vaccine that is different from the initial vaccine composition. For example, in some aspects, the initial vaccine is BNT162 or mRNA-1273 and the booster vaccine is a mRNA vaccine composition of the embodiments. In some aspects, a booster vaccine composition for a subject with high reactogenicity is selected based having a lower concentration of PEG or PEG-conjugate compared to the previously administered vaccine composition. In some aspects, a booster vaccine composition for a subject with high reactogenicity is selected based on a lower concentration of mRNA or LNP compared to the previously administered vaccine composition.

In certain aspects, a subject for treatment according to the embodiments is administered a vaccine composition as booster vaccine and has previously been treated with one or more administrations of a coronavirus vaccine composition. In certain aspects, the subject being treated with a booster vaccine previously was treated with a vaccine composition that included a spike protein antigen or a nucleic acid molecule encoding a spike protein antigen. In some aspects, the subject selected for treatment with the booster vaccine was previously administered a vaccine composition comprising, or encoding, a spike protein having a different amino acid sequence than the spike protein of the booster vaccine. In certain aspects, the previously administered vaccine composition comprised, or encoded, a spike (e.g., a SARS-CoV-2 spike) protein having at least 1, 2, 3, 4, 5, 6, 7, 8, 9, or 10 amino acid differences relative to the booster vaccine composition. In certain aspects, the booster vaccine composition comprises a RNA encoding a spike protein having about 1 to 50; about 3 to 30; about 5 to 30 or about 10 to 25 amino acid differences relative to the previously administered vaccine composition. In still further aspects, the booster vaccine composition comprises RNA encoding 2, 3, 4 or more distinct spike proteins with different amino acid sequences.

In further aspects, methods of the embodiments comprise administering 2 or more booster vaccine compositions to a subject, wherein each booster vaccine composition comprises RNA encoding a distinct spike protein with different amino acid sequences. In some aspects, such distinct booster vaccine compositions are administered essentially simultaneously or less than about 10 minutes, 20 minutes, 30 minutes, 1 hour or 2 hours apart. In some aspects, distinct booster vaccine compositions are administered to the same site, such as intramuscular injections to the same arm of the subject. In further aspects, distinct booster vaccine compositions are administered to different sites, such as intramuscular injections to different arms or to one or both arms and one more leg muscles.

In certain aspects, a method of the embodiments is further defined as a method of stimulating an antibody or CD8+ T-cell response in a subject. In some aspects, the method is defined as a method of stimulating a neutralizing antibody response in a subject. In further aspects, the method is defined as a method of stimulating a protective immune response in a subject. In yet further aspects, the method is defined as a method of stimulating TH2 directed immune response in a subject.

In further aspects, administration of a vaccine/composition/combination of the embodiments stimulates an antibody response that produces between about 10 and about 500 coronavirus spike protein-binding antibodies for every coronavirus neutralizing antibody in the subject. For example, the administration can stimulate an antibody response that produces no more than about 200 spike protein-binding antibodies for every coronavirus neutralizing antibody. In further aspects, the administration stimulates an antibody response that produces between about 10 and about 300; about 20 and about 300; about 20 and about 200; about 30 and about 100; or about 30 and about 80 coronavirus spike protein-binding antibodies for every coronavirus neutralizing antibody. In still further aspects, administration of composition of the embodiments stimulates an antibody response in a subject that includes a ratio of spike protein-binding antibodies to coronavirus neutralizing antibodies that is with 20%, 15%, 10% or 5% of the ratio of spike protein-binding antibodies to coronavirus neutralizing antibodies found in average convalescent patient serum (from a subject who has recovered from coronavirus infection).

In yet further aspects, administration of a vaccine/composition/combination of the embodiments stimulates an antibody response that produces between about 1 and about 500 coronavirus spike protein receptor binding domain (RBD)-binding antibodies for every coronavirus neutralizing antibody in the subject. In further aspects, the administration stimulates an antibody response that produces no more than about 50 spike protein RBD-binding antibodies for every coronavirus neutralizing antibody. In still further aspects, administration stimulates an antibody response that produces between about 1 and about 200; about 2 and about 100; about 3 and about 200; about 5 and about 100; about 5 and about 50; or about 5 and about 20 spike protein RBD-binding antibodies for every coronavirus neutralizing antibody. In still further aspects, administration of composition of the embodiments stimulates an antibody response in a subject that includes a ratio of spike protein RBD-binding antibodies to coronavirus neutralizing antibodies that is with 20%, 15%, 10% or 5% of the ratio of spike protein RBD-binding antibodies to coronavirus neutralizing antibodies found in average convalescent patient serum (from a subject who has recovered from coronavirus infection).

In still further aspects, administration of a vaccine/composition/combination of the embodiments induces essentially no increase in IL-4, IL-13, TNF and/or IL-1β in the subject. In further aspects, the administration of a vaccine/composition of the embodiments induces essentially no increase in serum IL-4, IL-13, TNF and/or IL-1β in the subject. In some aspects, the administration of a vaccine/composition of the embodiments induces essentially no increase in IL-4, IL-13, TNF and/or IL-1β at the injection site (e.g., an intramuscular injection site) in the subject. In still further aspects, a method of the embodiments comprises administration of a vaccine/composition of the embodiments to a human subject having a disease. In certain aspects, the subject has cardiovascular disease, kidney disease, lung disease or an autoimmune disease. In some aspects, a vaccine/composition of the embodiments is administered to a subject who is receiving anti-coagulation therapy.

In still further aspects, administering a vaccine/composition/combination of the embodiments to human subjects results in no more than 20%, 15%, 10% 7.5% or 5% of the subjects experiencing a Grade 3 local adverse event (see Table 3a below). For example, in some aspects, no more than 10% of subjects experience a Grade 3 local adverse event after a first or a second dose of the composition. In preferred aspects, administering a composition of the embodiments to human subjects results in no more than 40%, 30%, 25%, 20%, 15%, 10%, 7.5% or 5% of the subjects experiencing a Grade 2 of higher local adverse event. For example, in some aspects, no more than 30% of subjects experience a Grade 2 or higher local adverse event after a first or a second dose of the composition. In some aspects, administering a composition of the embodiments to human subjects results in no more than 10% of the subjects experiencing Grade 3 pain, redness, swelling and/or itching at the injection site In further aspects, administering a vaccine/composition/combination of the embodiments to human subjects results in no more than 30%, 25%, 20%, 15%, 10% or 5% of the subjects experiencing a Grade 3 systemic adverse event (see Table B below). For example, in some aspects, no more than 25% of subjects experience a Grade 3 systemic adverse event after a first dose of the composition. In some aspects, no more than 40% of subjects experience a Grade 3 systemic adverse event after a second dose of the composition. In some aspects, administering a composition of the embodiments to human subjects results in no more than 30%, 25%, 20%, 15%, 10% or 5% of the subjects experiencing Grade 3 fever, headache, fatigue, chills, myalgia, arthralgia, nausea and/or diarrhea.

TABLE 3a

Intensity Grading* for Solicited Local Adverse Events

| AE | Grade | Definition |
|---|---|---|
| Pain at Injection Site | 0 | Absent |
| | 1 | Does not interfere with activity |
| | 2 | Interferes with activity and/or repeated use of non-narcotic pain reliever >24 hours |
| | 3 | Prevents daily activity and/or repeated use of narcotic pain reliever |
| Redness | 0 | <2.5 cm |
| | 1 | 2.5-5 cm |
| | 2 | 5.1-10 cm |
| | 3 | >10 cm |
| Swelling | 0 | <2.5 cm |
| | 1 | 2.5-5 cm and does not interfere with activity |
| | 2 | 5.1-10 cm or interferes with activity |
| | 3 | >10 cm or prevents daily activity |
| Itching | 0 | Absent |
| | 1 | Mild, no interference with normal activity |
| | 2 | Moderate, some interference with normal activity |
| | 3 | Significant, prevents normal activity |

TABLE 3b

Intensity Grading* for Solicited Systemic Adverse Events

| Adverse Event | Grade | Definition |
|---|---|---|
| Fever | 0 | <38° C. |
| | 1 | ≥38.0-38.4° C. |
| | 2 | ≥38.5-38.9° C. |
| | 3 | ≥39° C. |
| Headache | 0 | Absent |
| | 1 | Mild, no interference with normal activity |
| | 2 | Moderate, some interference with normal activity and/or repeated use of non-narcotic pain reliever >24 hours |
| | 3 | Significant; any use of narcotic pain reliever and/or prevents daily activity |
| Fatigue | 0 | Absent |
| | 1 | Mild, no interference with normal activity |
| | 2 | Moderate, some interference with normal activity |
| | 3 | Significant, prevents normal activity |
| Chills | 0 | Absent |
| | 1 | Mild, no interference with normal activity |
| | 2 | Moderate, some interference with normal activity |
| | 3 | Significant, prevents normal activity |
| Myalgia | 0 | Absent |
| | 1 | Mild, no interference with normal activity |
| | 2 | Moderate, some interference with normal activity |
| | 3 | Significant, prevents normal activity |
| Arthralgia | 0 | Absent |
| | 1 | Mild, no interference with normal activity |

TABLE 3b-continued

Intensity Grading* for Solicited Systemic Adverse Events

| Adverse Event | Grade | Definition |
|---|---|---|
| | 2 | Moderate, some interference with normal activity |
| | 3 | Significant, prevents normal activity |
| Nausea/Vomiting | 0 | Absent |
| | 1 | Mild, no interference with activity and/or 1-2 episodes/24 hours |
| | 2 | Moderate, some interference with activity and/or >2 episodes/24 hours |
| | 3 | Significant, prevents daily activity, requires outpatient IV hydration |
| Diarrhea | 0 | Absent |
| | 1 | 2-3 loose stools over 24 hours |
| | 2 | 4-5 stools over 24 hours |
| | 3 | 6 or more watery stools over 24 hours or requires outpatient IV hydration |

*FDA toxicity grading scale (US Department of Health and Human Services. Food and Drug Administration (FDA). Guidance for Industry. Toxicity Grading Scale for Healthy Adult and Adolescent Volunteers Enrolled in Preventive Vaccine Clinical Trials. 2007. On the world wide web at fda.gov/downloads/BiologicsBloodVaccines/GuidanceCompliance-RegulatoryInformation/Guidances/Vaccines/ucm091977.pdf; Accessed at: March 2019, incorporated herein by reference); IV = Intravenous.

According to a further aspect, the present invention also provides a method for expression of at least one polypeptide comprising at least one peptide or protein derived from a coronavirus, or a fragment or variant thereof, wherein the method preferably comprises the following steps:

a) providing at least one nucleic acid of the first aspect or at least one composition of the second aspect; and
b) applying or administering said nucleic acid or composition to an expression system (cells), a tissue, an organism. A suitable cell for expressing a polypeptide (that is encoded by the nucleic acid of the invention) may be a Drosophila S2 insect cell line.

The method for expression may be applied for laboratory, for research, for diagnostic, for commercial production of peptides or proteins and/or for therapeutic purposes. The method may furthermore be carried out in the context of the treatment of a specific disease, particularly in the treatment of infectious diseases, particularly coronavirus infections, preferably SARS-CoV-2 coronavirus infections and the disease COVID-19.

Likewise, according to another aspect, the present invention also provides the use of the nucleic acid, the composition, the polypeptide, the vaccine, or the kit or kit of parts preferably for diagnostic or therapeutic purposes, e.g. for expression of an encoded coronavirus antigenic peptide or protein.

In specific embodiments, applying or administering said nucleic acid, polypeptide, composition, vaccine, combination to a tissue or an organism may be followed by e.g. a step of obtaining induced coronavirus antibodies e.g. SARS-CoV-2 coronavirus specific (monoclonal) antibodies or a step of obtaining generated SARS-CoV-2 coronavirus protein constructs (S protein).

The use may be applied for a (diagnostic) laboratory, for research, for diagnostics, for commercial production of peptides, proteins, or SARS-CoV-2 coronavirus antibodies and/or for therapeutic purposes. The use may be carried out in vitro, in vivo or ex vivo. The use may furthermore be carried out in the context of the treatment of a specific disease, particularly in the treatment of a coronavirus infection (e.g. COVID-19) or a related disorder.

According to a further aspect, the present invention also provides a method of manufacturing a composition or a vaccine, comprising the steps of:

a) RNA in vitro transcription step using a DNA template in the presence of a cap analogue to obtain capped mRNA, preferably having a nucleic acid sequence as provided in Table 2;
b) Purifying the obtained capped RNA of step a) using RP-HPLC, and/or TFF, and/or Oligo(dT) purification and/or AEX, preferably using RP-HPLC;
c) Providing a first liquid composition comprising the purified capped RNA of step b);
d) Providing a second liquid composition comprising at least one cationic lipid as defined herein, a neutral lipid as defined herein, a steroid or steroid analogue as defined herein, and a PEG-lipid as defined herein;
e) Introducing the first liquid composition and the second liquid composition into at least one mixing means to allow the formation of LNPs comprising capped RNA;
f) Purifying the obtained LNPs comprising capped RNA;
g) optionally, lyophilizing the purified LNPs comprising capped RNA.

Preferably, the mixing means of step e) is a T-piece connector or a microfluidic mixing device. Preferably, the purifying step f) comprises at least one step selected from precipitation step, dialysis step, filtration step, TFF step. Optionally, an enzymatic polyadenylation step may be performed after step a) or b). Optionally, further purification steps may be implemented to e.g. remove residual DNA, buffers, small RNA by-products etc. Optionally, RNA in vitro transcription is performed in the absence of a cap analog, and an enzymatic capping step is performed after RNA vitro transcription. Optionally, RNA in vitro transcription is performed in the presence of at least one modified nucleotide as defined herein.

In embodiments, step a, preferably steps a-c, more preferably all steps outlined above (a-g) are performed in an automated device for RNA in vitro transcription. Such a device may also be used to produce the composition or the vaccine (see aspects 2 and 3). Preferably, a device as described in WO2020/002598, in particular, a device as described in claims 1 to 59 and/or 68 to 76 of WO2020/002598 (and FIGS. 1-18) may suitably be used.

BRIEF DESCRIPTION OF LISTS AND TABLES

List 1a: Amino acid positions for substiutions deletions and/or insertions
List 1b: Amino acid substiutions deletions or insertions
Table 1: Preferred coronavirus constructs (amino acid sequences and nucleic acid coding sequences)
Table 2a: RNA constructs suitable for a coronavirus vaccine
Table 2b: RNA constructs suitable for a coronavirus vaccine
Table 3a: Intensity Grading for Solicited Local Adverse Events
Table 3b: Intensity Grading for Solicited Systemic Adverse Events
Table 4: RNA constructs encoding different SARS-CoV-2 S antigen design (used in the Examples)
Table 5: Lipid-based carrier composition of the examples
Table 6: Vaccination regimen
Table 7: Median VNTs (day 42)
Table 8: Vaccination regimen (Example 3)
Table 9: Vaccination regimen (Example 4)
Table 10: Vaccination regimen (Example 5)
Table 11: Vaccination regimen (Example 6)
Table 12: Vaccination regimen (Example 7)
Table 13: Vaccination regimen (Example 8)
Table 14A: Vaccination regime (Example 9A)
Table 14B: Vaccination regimen (Example 9B)
Table 15: Vaccination regimen (Example 10)
Table 16: Vaccination regimen (Example 11)
Table 17: Vaccination regimen (Example 12)
Table 18: Vaccination regime (Example 13)
Table 19: Vaccination regime (Example 14)

EXAMPLES

The following examples illustrate various embodiments and aspects of the invention. The present invention is not intended to in any way be limited in scope by the specific embodiments described herein. The following preparations and examples are given to enable those skilled in the art to more clearly understand and to practice the present invention. The present invention, however, is not limited in scope by the exemplified embodiments, which are intended as illustrations of single aspects of the invention only, and methods, which are functionally equivalent are within the scope of the invention. Indeed, various modifications of the invention in addition to those described herein will become readily apparent to those skilled in the art from the foregoing description, accompanying figures and the examples below. All such modifications fall within the scope of the appended claims.

Example 1: Preparation of DNA and RNA Constructs, Compositions, and Vaccines The present Example provides methods of obtaining the RNA of the invention as well as methods of generating a composition or a vaccine of the invention.

1.1. Preparation of DNA and RNA Constructs:

DNA sequences encoding different SARS-CoV-2 S protein designs were prepared and used for subsequent RNA in vitro transcription reactions. The DNA sequences were prepared by modifying the wild type or reference encoding DNA sequences by introducing a G/C optimized or modified coding sequence (e.g., “cds opt1”) for stabilization and expression optimization. Sequences were introduced into a pUC derived DNA vector to produce stabilizing 3'-UTR sequences and 5'-UTR sequences, additionally having a stretch of adenosines (e.g. A64 or A100), and optionally a histone-stem-loop (hSL) structure, and optionally a stretch of 30 cytosines (e.g. C30) (see Table 4, for an overview of coronavirus antigen designs see List 1 or Table 1).

The obtained plasmid DNA constructs were transformed and propagated in bacteria using common protocols known in the art. The plasmid DNA constructs were extracted, purified, and used for subsequent RNA in vitro transcription (see section 1.2.).

Alternatively, DNA plasmids can be used as template for PCR-amplification (see section 1.3.).

1.2. RNA In Vitro Transcription from Plasmid DNA Templates:

DNA plasmids prepared according to section 1.1 were enzymatically linearized using a restriction enzyme and used for DNA dependent RNA in vitro transcription using T7 RNA polymerase in the presence of a nucleotide mixture (ATP/GTP/CTP/UTP) and cap analog (e.g. m7GpppG, m7G(5')ppp(5')(2'OMeA)pG,m7G(5')ppp(5')(2'OMeG)pG), or 3'OMe-m7G(5')ppp(5')(2'OMeA)pG.) under suitable buffer conditions. The obtained RNA constructs were purified using RP-HPLC (PureMessenger®, CureVac AG, Tübingen, Germany; WO2008/077592) and used for in vitro and in vivo experiments. DNA templates may also be generated using PCR. Such PCR templates can be used for DNA dependent RNA in vitro transcription using an RNA polymerase as outlined herein.

To obtain chemically modified mRNA, RNA in vitro transcription was performed in the presence of a modified nucleotide mixture comprising N(1)-methylpseudouridine (m1ψ) or pseudouridine (ψ) instead of uracil. The obtained m1ψ or ψ chemically modified RNA was purified using RP-HPLC (PureMessenger®, CureVac AG, Tubingen, Germany; WO2008/077592) and used for further experiments.

Generation of capped RNA using enzymatic capping (prophetic):

Some RNA constructs are in vitro transcribed in the absence of a cap analog. The cap-structure (cap0 or cap1) is then added enzymatically using capping enzymes as commonly known in the art. In vitro transcribed RNA is capped using a capping kit to obtain cap0-RNA. cap0-RNA is additionally modified using cap specific 2'-O-methyltransferase to obtain cap1-RNA. cap1-RNA is purified e.g. as explained above and used for further experiments.

RNA for clinical development is produced under current good manufacturing practice e.g. according to WO2016/180430, implementing various quality control steps on DNA and RNA level.

The RNA Constructs of the Examples:

The generated RNA sequences/constructs are provided in Table 4 with the encoded antigenic protein and the respective UTR elements indicated therein. If not indicated otherwise, the RNA sequences/constructs of Table 4 were produced using RNA in vitro transcription in the presence of a m7GpppG, m7G(5')ppp(5')(2'OMeA)pG; accordingly, the RNA sequences/constructs comprise a 5' Cap1 structure. If not indicated otherwise, the RNA sequences/constructs of Table 4 have been produced in the absence of chemically modified nucleotides (e.g. pseudouridine (ψ) or N(1)-methylpseudouridine (m1ψ)).

1.3. RNA In Vitro Transcription from PCR Amplified DNA Templates (Prophetic):

Purified PCR amplified DNA templates prepared according to paragraph 1.1 is transcribed in vitro using DNA dependent T7 RNA polymerase in the presence of a nucleotide mixture (ATP/GTP/CTP/UTP) and cap analog (m7GpppG or 3'-O-Me-m7G(5')ppp(5')G)) under suitable buffer conditions. Alternatively, PCR amplified DNA is transcribed in vitro using DNA dependent T7 RNA polymerase in the presence of a modified nucleotide mixture (ATP, GTP, CTP, N1-methylpseudouridine (m1ψ) or pseudouridine (ψ) and cap analogue (m7GpppG, m7G(5')ppp(5')(2'OMeA)pG or m7G(5')ppp(5')(2'OMeG)pG) under suitable buffer conditions. Some RNA constructs are in vitro transcribed in the absence of a cap analog and the cap-structure (cap0 or cap1) is added enzymatically using capping enzymes as commonly known in the art. The obtained RNA is purified e.g. as explained above and used for further experiments. The obtained mRNAs are purified e.g. using RP-HPLC (PureMessenger®, CureVac AG, Tubingen, Germany; WO2008/077592) and used for in vitro and in vivo experiments.

TABLE 4

RNA constructs encoding different SARS-CoV-2 S antigen designs

| RNA ID | Short name |
|---|---|
| R9488, R9492, | S |
| R9487, R9491, R9709, R10159**, R10160, R10727**, R10820**, R10821** | S_stab_PP (K986P_V987P) |
| R10166, R10812**, R10813** | S_stab_PP (K986P_V987P_D614G) |
| R10811, R10814**, R10815** | S_stab_PP(K986P_V987P_D614G) |
| R10279 | S_stab_PP (K986P_V987P_A222V_D614G) |
| R10299 | S_stab_PP (K986P_V987P_N439K_D614G) |
| R10286 | S_stab_PP (K986P_V987P_S477N_D614G) |
| | S_stab_PP(K986P_V987P_N501Y_D614G) |
| R10275 | S_stab_PP (K986P_V987P_H69del_V70del_D614G) |
| R10283 | S_stab_PP (K986P_V987P_Y453F_D614G) |
| R10291 | S_stab_PP (K986P_V987P_D614G_I692V) |
| | S_stab_PP(K986P_V987P_D614G_M1229I) |
| R10295 | S_stab_PP (K986P_V987P_H69del_V70del_A222V_Y453F_S477N_D614G_I692V) |
| | S_stab_PP(K986P_V987P_H69del_V70del_Y453F_D614G_I692V_M1229I) |
| R10162** | S_stab_PP (K986P_V987P) |
| R10357 | S_stab_PP (K986P_V987P_H69del_V70del_Y144del_N501Y_A570D_D614G_P681H_T716I_S982A_D1118H) |
| R10361 | S_stab_PP (K986P_V987P_K417N_E484K_N501Y_D614G) |
| R10384 | S_stab_PP (K986P_V987P_L18F_D80A_D215G_L242del_A243del_L244del_R246I_K417N_E484K_N501Y_D614G_A701V) |

TABLE 4-continued

| RNA constructs encoding different SARS-CoV-2 S antigen designs | |
|---|---|
| R10385 | S_stab_PP (K986P_V987P_L18F_T20N_P26S_D138Y_R190S_K417T_E484K_N501Y_D614G_H655Y_T1027I) |
| R10410 | S_stab_PP (K986P_V987P_H69del_V70del_Y144del_N501Y_A570D_D614G_P681H_T716I_S982A_D1118H_E484K) |
| R10452 | S_stab_PP (K986P_V987P_L18F_D80A_D215G_L242del_A243del_L244del_R246I_K417N_E484K_N501Y_D614G_A701V) |
| R9515 | S_stab_PP (K986P_V987P) |
| R10385 | S_stab_PP(K986P_V987P_L18F_T20N_P26S_D138Y_R190S_K417T_E484K_N501Y_D614G_H655Y_T1027I) |
| R10616 | S_stab_PP(K986P_V987P_L18F_T20N_P26S_D138Y_R190S_K417T_E484K_N501Y_D614G_H655Y_T1027I_V1176F) |
| P5335 | S_stab_PP(K986P_V987P_E484K_D614G_V1176F) |
| R10614 | S_stab_PP(K986P_V987P_S13I_W152C_L452R_D614G) |
| R10520 | S_stab_PP(K986P_V987P_Q52R_A67V_H69del_V70del_Y144del_E484K_D614G_Q677H_F888L) |
| R10577 | S_stab_PP(K986P_V987P_A67V_H69del_V70del_Y144del_E484K_D614G_Q677H_F888L) |
| R10598 | S_stab_PP(K986P_V987P_L452R_D614G_P681R) |
| P5333 | S_stab_PP(K986P_V987P_E154K_L452R_E484Q_D614G_P681R_Q1071H) |
| R10630, R10827**, R10828**, R11043, R11160**, R11161** | S_stab_PP(K986P_V987P_T19R_F157del_R158del_L452R_T478K_D614G_P681R_D950N) |
| R10824, R10825**, R10826** | S_stab_PP(K986P_V987P_T19R_F157del_R158del_L452R_T478K_D614G_P681R_D950N) |
| P5336, R10800 | S_stab_PP(K986P_V987P_G75V_T76I_R246del_S247del_Y248del_L249del_T250del_P251del_G252del_L452Q_F490S_D614G_T859N) |
| R10575 | S_stab_PP(K986P_V987P_H69del_V70del_N439K_D614G) |
| R10579 | S_stab_PP(K986P_V987P_L5F_T95I_D253G_E484K_D614G_A701V) |
| R10581 | S_stab_PP(K986P_V987P_L5F_T95I_D253G_S477N_D614G_Q957R) |
| R10592 | S_stab_PP(K986P_V987P_F157L_V367F_Q613H_P681R) |
| R10615 | S_stab_PP(K986P_V987P_S254F_D614G_P681R_G769V) |
| P5418 | S_stab_PP(K986P_V987P_P26S_H69del_V70del_V126A_Y144del_L242del_A243del_L244del_H245Y_S477N_E484K_D614G_P681H_T1027I_D1118H) |
| R10679 | S_stab_PP(K986P_V987P_T95I_Y144T_Y145S_ins145N_R346K_E484K_N501Y_D614G_P681H_D950N) |
| P5420 | S_stab_PP(K986P_V987P_ins214TDR_Q414K_N450K_D614G_T716I) |
| P5416 | S_stab_PP(K986P_V987P_T478K_D614G_P681H_T732A) |
| | S_stab_PP(K986P_V987P_E484K_N501Y_D614G_P681H_E1092K_H1101Y_V1176F) |
| | S_stab_PP(K986P_V987P_H66D_G142V_Y144del_Y145del_D215G_V483A_D614G_H655Y_G669S_Q949R_N1187D) |
| | S_stab_PP(K986P_V987P_Y144del_L452R_T478K_P681R) |
| | S_stab_PP(K986P_V987P_T19R_Y144del_Y145del_L452R_T478K_D614G_P681R) |
| R10922 | S_stab_PP(K986P_V987P_P9L_C136F_Y144del_R190S_D215G_L242del_A243del_Y449H_E484K_N501Y_D614G_H655Y_N679K_T716I_T859N) |
| R11175, R11176, R11177**, R11178** | S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_N764K_D796Y_N856K_Q954H_N969K_L981F);<br>S_stab_PP(K986P_V987P_BA.1_v1)<br>S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_N764K_D796Y_N856K_Q954H_N969K_L981F);<br>S_stab_PP(K986P_V987P_BA.1_v1 |
| R11113, R11114, R11115**, R11116** | S_stab_PP(K986P_V987P_A67V_H69del_V70del_T95I_G142D_V143del_Y144del_Y145del_N211del_L212I_ins214EPE_G339D_S371L_S373P_S375F_K417N_N440K_G446S_S477N_T478K_E484A_Q493R_G496S_Q498R_N501Y_Y505H_T547K_D614G_H655Y_N679K_P681H_N764K_D796Y_N856K_Q954H_N969K_L981F);<br>S_stab_PP(K986P_V987P_BA.1_v0)<br>S_stab_PP(K986P_V987P_A67V_H69del_V70del_T95I_G142D_V143del_Y144del_Y145del_N211del_L212I_ins214EPE_G339D_S371L_S373P_S375F_K417N_N440K_G446S_S477N_T478K_E484A_ |

TABLE 4-continued

| RNA constructs encoding different SARS-CoV-2 S antigen designs | |
|---|---|
| | Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v0) |
| | S_stab_PP(K986P_V987P_A67V_T95I_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_B.1.1.529) |
| | S_stab_PP(K986P_V987P_A67V_T95I_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_B.1.1.529) |
| | S_stab_PP(K986P_V987P_T19I_L24del_P25del_P26del_A27S_G142D_V213G_G339D_S371F_S373P_S375F_T376A_D405N_S477N_T478K_E484A_Q493R_Q498R_N501Y_Y505H_D614G_H655Y_N679K_P681H_D796Y_Q954H_N969K); S_stab_PP(K986P_V987P_BA.2) |
| | S_stab_PP(K986P_V987P_T19I_L24del_P25del_P26del_A27S_G142D_V213G_G339D_S371F_S373P_S375F_T376A_D405N_S477N_T478K_E484A_Q493R_Q498R_N501Y_Y505H_D614G_H655Y_N679K_P681H_D796Y_Q954H_N969K); S_stab_PP(K986P_V987P_BA.2) |
| P5508 | S_stab_PP(K986P_V987P_G75V_T76I_R246del_S247del_Y248del_L249del_T250del_P251del_G252del_D253N_L452Q_F490S_D614G_T859N) |
| P5453 | S_stab_PP(K986P_V987P_S12F_H69del_V70del_W152R_R346S_L452R_D614G_Q677H_A899S) |
| P5507 | S_stab_PP(K986P_V987P_I210T_N440K_E484K_D614G_D936N_S939F_T10271) |
| P5509 | S_stab_PP(K986P_V987P_W152L_E484K_D614G_G769V) |
| P5572 | S_stab_PP(K986P_V987P_T20I_R357K_D614G) |
| P5664 | S_stab_PP(K986P_V987P_T95I_Y144del_E484K_D614G_P681H_D796H) |
| R10884 | S_stab_PP(K986P_V987P_T19R_G142D_E156G_F157del_R158del_L452R_T478K_D614G_P681R_D950N) |
| R10801, R10832**, R10833** | S_stab_PP(K986P_V987P_T19R_T95I_G142D_E156G_F157del_R158del_W258L_K417N_L452R_T478K_D614G_P681R_D950N) |
| R10829, R10830**, R10831** | S_stab_PP(K986P_V987P_T19R_T95I_G142D_E156G_F157del_R158del_W258L_K417N_L452R_T478K_D614G_P681R_D950N) |
| R10802 | S_stab_PP(K986P_V987P_T19R_V70F_G142D_E156G_F157del_R158del_A222V_K417N_L452R_T478K_D614G_P681R_D950N) |
| P5662 | S_stab_PP(K986P_V987P_T19R_T95I_G142D_E156G_F157del_R158del_L452R_T478K_D614G_P681R_D950N) |
| P5663 | S_stab_PP(K986P_V987P_T19R_E156G_F157del_R158del_L452R_T478K_D614G_P681R_D950N) |
| R11036 | S_stab_PP(K986P_V987P_T19R_T95I_G142D_Y145H_E156G_F157del_R158del_A222V_L452R_T478K_D614G_P681R_D950N) |
| P5454 | S_stab_PP(K986P_V987P_T19R_L452R_E484Q_D614G_P681R_D950N) |
| | S_stab_PP(K986P_V987P_A67V_H69del_V70del_T95I_G142D_V143del_Y144del_Y145del_N211del_L212I_ins214EPE_G339D_S371L_S373P_S375F_N440K_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v2) |
| | S_stab_PP(K986P_V987P_A67V_H69del_V70del_T95I_G142D_V143del_Y144del_Y145del_N211del_L212I_ins214EPE_G339D_S371L_S373P_S375F_N440K_S477N_T478K_E484A_Q493R_G496S_Q498R_N501Y_Y505H_T547K_D614G_H655Y_N679K_P681H_N764K_D796Y_N856K_Q954H_N969K_L981F); S_stab_PP(K986P_V987P_BA.1_v2) |
| | S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_BA.1_v3) |
| | S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_D796Y_N856K_Q954H_N969K_L981F); S_stab_PP(K986P_V987P_BA.1_v3) |
| | S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_A701V_N764K_ |

TABLE 4-continued

| RNA constructs encoding different SARS-CoV-2 S antigen designs |
|---|
| D796Y_N856K_Q954H_N969K_L981F);<br>S_stab_PP(K986P_V987P_BA.1_v4)<br>S_stab_PP(K986P_V987P_A67V_H69del_V70del_T95I_G142D_V143del_Y144del_Y145del_N211del_L212I_ins214EPE_G339D_S371L_S373P_S375F_S477N_T478K_E484A_Q493R_G496S_Q498R_N501Y_Y505H_T547K_D614G_H655Y_N679K_P681H_A701V_N764K_D796Y_N856K_Q954H_N969K_L981F);<br>S_stab_PP(K986P_V987P_BA.1_v4)<br>S_stab_PP(K986P_V987P_A67V_H69del_V70del_T95I_G142D_V143del_Y144del_Y145del_N211del_L212I_ins214EPE_G339D_S371L_S373P_S375F_G446S_S477N_T478K_E484A_Q493R_G496S_Q498R_N501Y_Y505H_T547K_D614G_H655Y_N679K_P681H_N764K_D796Y_N856K_Q954H_N969K_L981F);<br>S_stab_PP(K986P_V987P_BA.1_v5)<br>S_stab_PP(K986P_V987P_A67V_H69del_V70del_T95I_G142D_V143del_Y144del_Y145del_N211del_L212I_ins214EPE_G339D_S371L_S373P_S375F_G446S_S477N_T478K_E484A_Q493R_G496S_Q498R_N501Y_Y505H_T547K_D614G_H655Y_N679K_P681H_N764K_D796Y_N856K_Q954H_N969K_L981F);<br>S_stab_PP(K986P_V987P_BA.1_v5) |

| RNA ID | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|
| R9488, R9492, | opt1 (go) | HSD17B4/ PSMB3; a-1 | hSL-A100 | 1 | 136 | 148 |
| R9487, R9491, R9709, R10159**, R10160, R10727**, R10820**, R10821** | opt1 (go) | HSD17B4/ PSMB3; a-1 | hSL-A100 | 10 | 137 | 149, 28736 |
| R10166, R10812**, R10813** | opt1 (go) | HSD17B4/ PSMB3; a-1 | hSL-A100 | 22738 | 22765 | 22792, 28737 |
| R10811, R10814**, R10815** | opt1 (go) | HSD17B4/ PSMB3; a-1 | A100 | 22738 | 22765 | 24838, 28827 |
| R10279 | opt1 (go) | HSD17B4/ PSMB3; a-1 | hSL-A100 | 22740 | 22767 | 22794 |
| R10299 | opt1 (go) | HSD17B4/ PSMB3; a-1 | hSL-A100 | 22742 | 22769 | 22796 |
| R10286 | opt1 (go) | HSD17B4/ PSMB3; a-1 | hSL-A100 | 22744 | 22771 | 22798 |
| | opt1 (go) | HSD17B4/ PSMB3; a-1 | hSL-A100 | 22746 | 22773 | 22800 |
| R10275 | opt1 (go) | HSD17B4/ PSMB3; a-1 | hSL-A100 | 22748 | 22775 | 22802 |
| R10283 | opt1 (go) | HSD17B4/ PSMB3; a-1 | hSL-A100 | 22750 | 22777 | 22804 |
| R10291 | opt1 (go) | HSD17B4/ PSMB3; a-1 | hSL-A100 | 22752 | 22779 | 22806 |
| | opt1 (go) | HSD17B4/ PSMB3; a-1 | hSL-A100 | 22754 | 22781 | 22808 |
| R10295 | opt1 (go) | HSD17B4/ PSMB3; a-1 | hSL-A100 | 22756 | 22783 | 22810 |
| | opt1 (go) | HSD17B4/ PSMB3; a-1 | hSL-A100 | 22758 | 22785 | 22812 |
| R10162** | opt10 (go mod) | HSD17B4/ PSMB3; a-1 | hSL-A100 | 10 | 146 | 151 |

TABLE 4-continued

RNA constructs encoding different SARS-CoV-2 S antigen designs

| | | | | | | |
|---|---|---|---|---|---|---|
| R10357 | opt1 (go) | HSD17B4/ PSMB3; a-1 | hSL-A100 | 22959 | 23089 | 23529 |
| R10361 | opt1 (go) | HSD17B4/ PSMB3; a-1 | hSL-A100 | 22960 | 23090 | 23530 |
| R10384 | opt1 (go) | HSD17B4/ PSMB3; a-1 | hSL-A100 | 22961 | 23091 | 23531 |
| R10385 | opt1 (go) | HSD17B4/ PSMB3; a-1 | hSL-A100 | 22963 | 23093 | 23533 |
| R10410 | opt1 (go) | HSD17B4/ PSMB3; a-1 | hSL-A100 | * | * | * |
| R10452 | opt1 (go) | HSD17B4/ PSMB3; a-1 | A100 | 22961 | 23091 | * |
| R9515 | opt1 (go) | -/muag; i-3 | A64-N5-C30-hSL-N5 | 10 | 137 | 163 |
| R10385 | opt1 (go) | HSD17B4/ PSMB3; a-1 | hSL-A100 | 22963 | 23093 | 23533 |
| R10616 | opt1 (go) | HSD17B4/ PSMB3; a-1 | hSL-A100 | 27091 | 27114 | 27390 |
| P5335 | opt1 (go) | HSD17B4/ PSMB3; a-1 | hSL-A100 | 27092 | 27115 | 27391 |
| R10614 | opt1 (go) | HSD17B4/ PSMB3; a-1 | hSL-A100 | 22964 | 23094 | 23534 |
| R10520 | opt1 (go) | HSD17B4/ PSMB3; a-1 | hSL-A100 | 27089 | 27112 | 27388 |
| R10577 | opt1 (go) | HSD17B4/ PSMB3; a-1 | hSL-A100 | 27090 | 27113 | 27389 |
| R10598 | opt1 (go) | HSD17B4/ PSMB3; a-1 | hSL-A100 | 27093 | 27116 | 27392 |
| P5333 | opt1 (go) | HSD17B4/ PSMB3; a-1 | hSL-A100 | 27094 | 27117 | 27393 |
| R10630, R10827**, R10828**, R11043, R11160**, R11161** | opt1 (go) | HSD17B4/ PSMB3; a-1 | hSL-A100 | 27095 | 27118 | 27394, 28762 |
| R10824, R10825**, R10826** | opt1 (go) | HSD17B4/ PSMB3; a-1 | A100 | 27095 | 27118 | 27532, 28852 |
| P5336, R10800 | opt1 (go) | HSD17B4/ PSMB3; a-1 | hSL-A100 | 27096 | 27119 | 27395 |
| R10575 | opt1 (go) | HSD17B4/ PSMB3; a-1 | hSL-A100 | 27097 | 27120 | 27396 |
| R10579 | opt1 (go) | HSD17B4/ PSMB3; a-1 | hSL-A100 | 27098 | 27121 | 27397 |
| R10581 | opt1 (go) | HSD17B4/ PSMB3; a-1 | hSL-A100 | 27099 | 27122 | 27398 |
| R10592 | opt1 (go) | HSD17B4/ PSMB3; a-1 | hSL-A100 | 27100 | 27123 | 27399 |
| R10615 | opt1 (go) | HSD17B4/ PSMB3; a-1 | hSL-A100 | 27101 | 27124 | 27400 |
| P5418 | opt1 (go) | HSD17B4/ PSMB3; a-1 | hSL-A100 | 27102 | 27125 | 27401 |
| R10679 | opt1 (go) | HSD17B4/ PSMB3; a-1 | hSL-A100 | 27103 | 27126 | 27402 |

TABLE 4-continued

RNA constructs encoding different SARS-CoV-2 S antigen designs

| | | | | | | |
|---|---|---|---|---|---|---|
| P5420 | opt1 (go) | HSD17B4/ PSMB3; a-1 | hSL-A100 | 27104 | 27127 | 27403 |
| P5416 | opt1 (go) | HSD17B4/ PSMB3; a-1 | hSL-A100 | 27105 | 27128 | 27404 |
| | opt1 (go) | HSD17B4/ PSMB3; a-1 | hSL-A100 | 27106 | 27129 | 27405 |
| | opt1 (go) | HSD17B4/ PSMB3; a-1 | hSL-A100 | 27107 | 27130 | 27406 |
| | opt1 (go) | HSD17B4/ PSMB3; a-1 | hSL-A100 | 27108 | 27131 | 27407 |
| | opt1 (go) | HSD17B4/ PSMB3; a-1 | hSL-A100 | 27109 | 27132 | 27408 |
| R10922 | opt1 (go) | HSD17B4/ PSMB3; a-1 | hSL-A100 | 28540 | 28589 | 28638 |
| R11175, R11176, R11177**, R11178** | opt1 (go) | HSD17B4/ PSMB3; a-1 | hSL-A100 | 28541 | 28590 | 28639, 28778 |
| | opt1 (go) | HSD17B4/ PSMB3; a-1 | A100 | 28541 | 28590 | 28688, 28868 |
| R11113, R11114, R11115**, R11116** | opt1 (go) | HSD17B4/ PSMB3; a-1 | hSL-A100 | 28542 | 28591 | 28640, 28779 |
| | opt1 (go) | HSD17B4/ PSMB3; a-1 | A100 | 28542 | 28591 | 28689, 28869 |
| | opt1 (go) | HSD17B4/ PSMB3; a-1 | hSL-A100 | 28543 | 28592 | 28641, 28780 |
| | opt1 (go) | HSD17B4/ PSMB3; a-1 | A100 | 28543 | 28592 | 28690, 28870 |
| | opt1 (go) | HSD17B4/ PSMB3; a-1 | hSL-A100 | 28544 | 28593 | 28642, 28781 |
| | opt1 (go) | HSD17B4/ PSMB3; a-1 | A100 | 28544 | 28593 | 28691, 28871 |
| P5508 | opt1 (go) | HSD17B4/ PSMB3; a-1 | hSL-A100 | 28545 | 28594 | 28643 |
| P5453 | opt1 (go) | HSD17B4/ PSMB3; a-1 | hSL-A100 | 28547 | 28596 | 28645 |
| P5507 | opt1 (go) | HSD17B4/ PSMB3; a-1 | hSL-A100 | 28548 | 28597 | 28646 |
| P5509 | opt1 (go) | HSD17B4/ PSMB3; a-1 | hSL-A100 | 28549 | 28598 | 28647 |
| P5572 | opt1 (go) | HSD17B4/ PSMB3; a-1 | hSL-A100 | 28550 | 28599 | 28648 |
| P5664 | opt1 (go) | HSD17B4/ PSMB3; a-1 | hSL-A100 | 28551 | 28600 | 28649 |
| R10884 | opt1 (go) | HSD17B4/ PSMB3; a-1 | hSL-A100 | 28552 | 28601 | 28650 |
| R10801, R10832**, R10833** | opt1 (go) | HSD17B4/ PSMB3; a-1 | hSL-A100 | 28553 | 28602 | 28651, 28790 |
| R10829, R10830**, R10831** | opt1 (go) | HSD17B4/ PSMB3; a-1 | A100 | 28553 | 28602 | 28700, 28880 |
| R10802 | opt1 (go) | HSD17B4/ PSMB3; a-1 | hSL-A100 | 28554 | 28603 | 28652 |

TABLE 4-continued

| RNA constructs encoding different SARS-CoV-2 S antigen designs | | | | | | |
|---|---|---|---|---|---|---|
| P5662 | opt1 (go) | HSD17B4/ PSMB3; a-1 | hSL-A100 | 28555 | 28604 | 28653 |
| P5663 | opt1 (go) | HSD17B4/ PSMB3; a-1 | hSL-A100 | 28556 | 28605 | 28654 |
| R11036 | opt1 (go) | HSD17B4/ PSMB3; a-1 | hSL-A100 | 28557 | 28606 | 28655 |
| P5454 | opt1 (go) | HSD17B4/ PSMB3; a-1 | hSL-A100 | 28558 | 28607 | 28656 |
| | opt1 (go) | HSD17B4/ PSMB3; a-1 | hSL-A100 | 28917 | 28921 | 28927, 28935 |
| | opt1 (go) | HSD17B4/ PSMB3; a-1 | A100 | 28917 | 28921 | 28929, 28937 |
| | opt1 (go) | HSD17B4/ PSMB3; a-1 | hSL-A100 | 28918 | 28922 | 28926, 28934 |
| | opt1 (go) | HSD17B4/ PSMB3; a-1 | A100 | 28918 | 28922 | 28930, 28938 |
| | opt1 (go) | HSD17B4/ PSMB3; a-1 | hSL-A100 | 28919 | 28923 | 28927, 28935 |
| | opt1 (go) | HSD17B4/ PSMB3; a-1 | A100 | 28919 | 28923 | 28931, 28939 |
| | opt1 (go) | HSD17B4/ PSMB3; a-1 | hSL-A100 | 28920 | 28924 | 28928, 28936 |
| | opt1 (go) | HSD17B4/ PSMB3; a-1 | A100 | 28920 | 28924 | 28932, 28940 |

**mRNA R10159, R10162, R10157, R10712, R10813, R10815, R10821, R10823, R10826, R10828, R10831, R10833, R11116, R11120, R11161, R11178 were produced with N(1)-methylpseudouridine (m1ψ); R10727, R10728, R10812, R10814, R10820, R10822, R10825, R10827, R10830, R10832, R11115, R11119, R11160, R11177 were produced with pseudouridine (ψ))

Spike prefusion stabilized protein (=S_stab),

Spike protein (=S)

1.4. Preparation of an LNP Formulated mRNA Composition:

LNPs were prepared using cationic lipids, structural lipids, a PEG-lipids, and cholesterol. Lipid solution (in ethanol) was mixed with RNA solution (aqueous buffer) using a microfluidic mixing device. Obtained LNPs were re-buffered in a carbohydrate buffer via dialysis, and up-concentrated to a target concentration using ultracentrifugation tubes. LNP-formulated mRNA was stored at −80° C. prior to use in in vitro or in vivo experiments.

Lipid nanoparticles were prepared and tested according to the general procedures described in PCT Pub. Nos. WO2015/199952, WO2017/004143 and WO2017/075531, the full disclosures of which are incorporated herein by reference. Lipid nanoparticle (LNP)-formulated mRNA was prepared using an ionizable amino lipid (cationic lipid), phospholipid, cholesterol and a PEGylated lipid. LNPs were prepared as follows. Cationic lipid according to formuala III-3 (ALC-0315), DSPC, cholesterol and PEG-lipid according to formula IVa (ALC-0159) were solubilized in ethanol at a molar ratio of approximately 47.5:10:40.8:1.7 (see Table 5). Lipid nanoparticles (LNP) comprising compound III-3 were prepared at a ratio of mRNA (sequences see Table 4) to Total Lipid of 0.03-0.04 w/w. Briefly, the mRNA was diluted to 0.05 to 0.2 mg/mL in 10 to 50 mM citrate buffer, pH 4. Syringe pumps were used to mix the ethanolic lipid solution with the mRNA aqueous solution at a ratio of about 1:5 to 1:3 (vol/vol) with total flow rates above 15 ml/min. The ethanol was then removed and the external buffer replaced with PBS by dialysis. Finally, the lipid nanoparticles were filtered through a 0.2 μm pore sterile filter. Lipid nanoparticle particle diameter size was 60-90 nm as determined by quasi-elastic light scattering using a Malvern Zetasizer Nano (Malvern, UK).

TABLE 5

Lipid-based carrier composition of the examples

| Compounds | Ratio (mol %) | Structure | Mass |
|---|---|---|---|
| 1 Cholesterol | 40.9 | 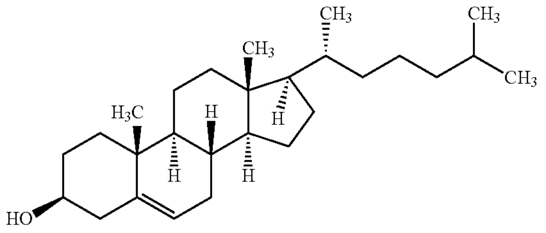 | 386.4 |
| 2 1,2-distearoyl-sn-glycero-3-phosphocholine (DSPC) | 10 | 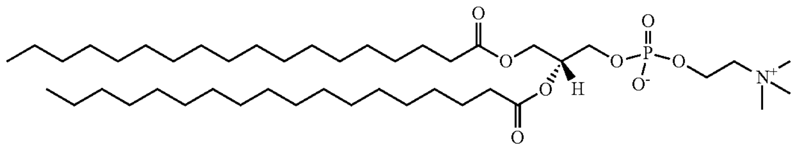 [SMILES: CCCCCCCCCCCCCCCCCC(=O)OC[C@H](COP(=O)([O-])OCC[N+](C)(C)C)OC(=O)CCCCCCCCCCCCCCCCC] | 789.6 |
| 3 Cationic Lipid | 47.4 | 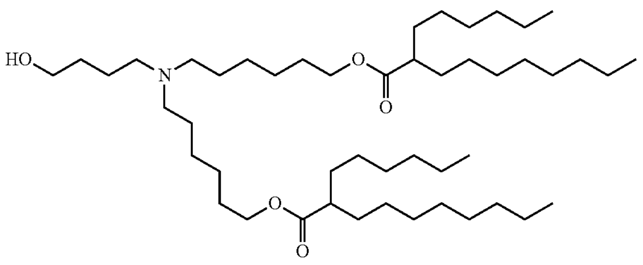 [SMILES: CCCCCCCCC(CCCCCC)C(=O)OCCCCCCN(CCCCO)CCCCCCOC(=O)C(CCCCCC)CCCCCCCC] | 765.7 |
| 4 PEG Lipid | 1.7 | 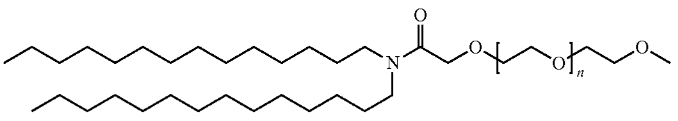 Average n = ~49 | 2010.1 |

1.5. Preparation of Combination mRNA Vaccines Comprising Antigen Combinations (Bivalent or Multivalent Vaccine Compositions):

Combination mRNA vaccines were formulated with LNPs either in a separate or co-formulated way. For separately mixed or formulated mRNA vaccines, each mRNA component was prepared and separately LNP formulated as described in Example 1.4, followed by mixing of the different LNP-formulated components. For co-formulated mRNA vaccine, the different mRNA components are firstly mixed together, followed by a co-formulation in LNPs as described in Example 1.4.

Example 2: Multivalency Study in Rats: Immunogenicity of a Bivalent CV2CoV (R9709) and CV2CoV.351 (R10384) Vaccine Upon i.m. Administration in Wistar Rats In this study, the humoral immunogenicity induced by LNP-formulated bivalent mRNA vaccine CV2CoV/CV2CoV.351 (R9709/R10384) was evaluated in Wistar rats in comparison to CV2CoV (R9709) or CV2CoV.351 (R10384).

Preparation of LNP Formulated mRNA Vaccine:

SARS-CoV-2 mRNA constructs (CV2CoV-mRNA based SARS-CoV-2 vaccine encoding for full length, pre-fusion stabilized ancestral SARS-CoV-2 S and CV2CoV.351-mRNA based SARS-CoV-2 vaccine encoding for full length, pre-fusion stabilized SARS-CoV-2 B.1.351 S) were prepared as described in Example 1.2 (RNA in vitro transcription). HPLC purified mRNA was formulated with LNPs according to Example 1.4 and Example 1.5 (separately mixed or formulated "mixed 2 LNPs" or co-formulated "mixed 1 LNP" for bivalent mRNA vaccines (group F, G, H) prior to use in in vivo vaccination experiments.

Immunization:

Rats were injected intramuscularly (i.m.) with mRNA vaccine compositions and doses as indicated in Table 6. Buffer vaccinated animals served as a negative control (group A). All animals were vaccinated on day 0 and day 21. Blood samples were collected on day 14, day 21 and day 42 for the determination of humoral immune responses.

TABLE 6

| Vaccination regimen (Example 2) | | | | | |
|---|---|---|---|---|---|
| Group | Animals | 1st vaccination | 2nd vaccination | Immunisation schedule | Serum isolation |
| A | N = 4 | NaCl | NaCl | | |
| B | Wistar | CV2CoV 8 μg | CV2CoV 8 μg | D 0, | D 14 |
| C | Female | CV2CoV.351 8 μg | CV2CoV.351 8 μg | D 21 | D 21 |
| D | N = 6 | CV2CoV 8 μg | CV2CoV.351 8 μg | | D 42 |
| E | | CV2CoV.351 8 μg | CV2CoV 8 μg | | |
| F | | CV2CoV + CV2CoV.351 mixed 1 LNP 8 μg | CV2CoV + CV2CoV.351 mixed 1 LNP 8 μg | | |
| G | | CV2CoV + CV2CoV.351 mixed 2 LNPs 8 μg | CV2CoV + CV2CoV.351: mixed 2 LNPs 8 μg | | |
| H | | CV2CoV (left leg) 4 μg CV2CoV.351 (right leg) 4 μg | CV2CoV (left leg) 4 μg CV2CoV.351 (right leg) 4 μg | | |

CV2CoV is shown as R9709 in Table 4 and CV2CoV.351 is shown as R10384 in Table 4

Determination of IgG1 and IgG2 Spike-Binding Antibody Titers Using ELISA:

Anti-SARS-CoV-2 Spike RBD protein specific binding antibodies, displayed as endpoint titers for IgG1 and IgG2a, were determined in sera isolated on day 14 and day 21. Recombinant SARS-CoV-2 Spike RBD protein or recombinant SARS-CoV-2 B.1.351 Spike protein RBD (K417N, E484K, N501Y) was used for coating. Coated plates were incubated using respective serum dilutions, and binding of specific antibodies to RBD were detected with a biotinylated antibody.

Determination of VNTs

For the analysis of VNTs of rat sera, serial dilutions of heat-inactivated sera (56° C. for 30 min) tested in duplicates with a starting dilution of 1:10 followed by 1:2 serial dilutions were incubated with 100 TCID50 of SARS-CoV-2. For this, different viruses were employed:

ancestral SARS-CoV-2: strain 2019-nCov/Italy-INMI derived from the EVAg

B.1.351 variant SARS-CoV-2: strain hCoV-19/Netherlands/NoordHolland_10159/2021, South African variant, nextstrain clade 20H, lineage B.1.351 supplied by the EVAg B.1.1.7 variant SARS-CoV-2: strain 14484 human swab isolated by VisMederi Research, which contains the following mutations compared to ancestral virus: N501Y, A570D, T5721, D614G, P681H, T716I, S735L, S982A, D1118H. Of note, these mutations differ from the consensus sequence of the variant4, i.e. deletions dH69N70 and dY144 are missing and T5721 and S735L represent additional mutations.

P.1 variant SARS-CoV-2 strain: PG_253 isolated by University of Siena, containing the following mutations: L18F T20N P26S D138Y R190S K417T E484K N501Y D614G H655Y T1027I and V1176F of wild type SARS-CoV-2 (strain 2019-nCov/Italy-INMI derived from the EVAg) or the B.1.351 variant SARS-CoV-2 (strain hCoV-19/Netherlands/NoordHolland_10159/2021, South African variant, next strain clade 20H, lineage B.1.351 supplied by the EVAg)

Virus was incubated for 1 hour at 37° C. Every plate contained a dedicated row (8 wells) for cell control, which contains only cells and medium, and a dedicated row of virus control, which contains only cells and virus. Infectious virus was quantified upon incubation of 100 μl of virus-serum mixture with a confluent layer of Vero E6 cells (ATCC, Cat.1586) followed by incubation for 3 days (ancestral SARS-CoV-2) or 4 days (SARS-CoV-2 B.1.351, B.1.1.7 and P.1) at 37° C. and microscopical scoring for CPE formation. A back titration was performed for each run in order to verify the correct range of TCID50 of the working virus solution. VN titers were calculated according to the method described by Reed & Muench. If no neutralization was observed (MNt<10), an arbitrary value of 5 was reported. Analyses were carried out at VisMederi srl (Siena, Italy).

Figure 1:
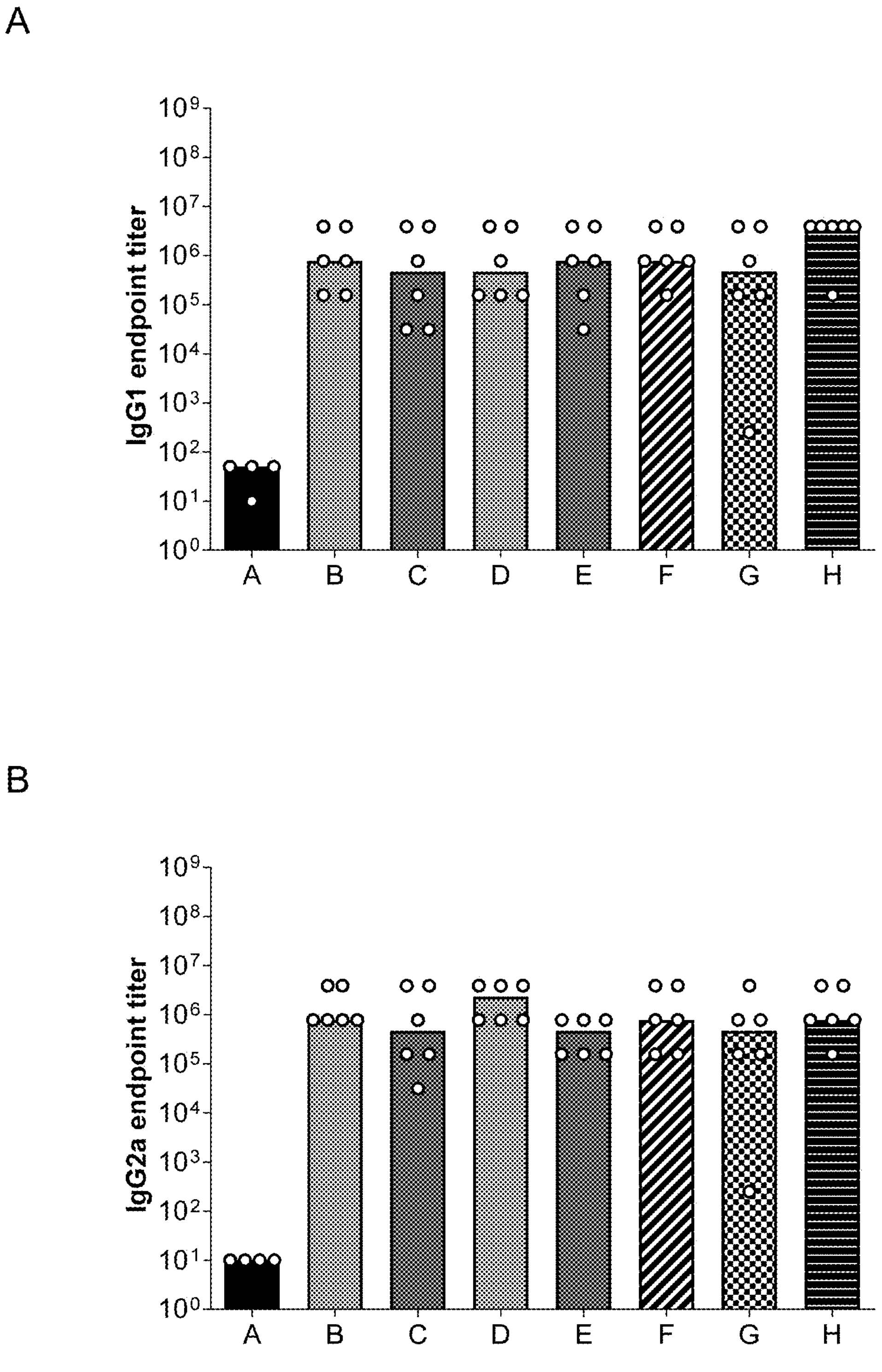
FIG. 1 shows significant IgG1 and IgG2a binding antibody responses to the receptor binding domain (RBD) of ancestral SARS-CoV-2 and the RBD of the B.1.351 variant on day 14 (FIG. 1A-D) and on day 21 (FIG. 1 E-H) for the group vaccinated with the mRNA vaccine CV2CoV and the CV2CoV.351, both formulated in LNPs. On day 14.
Figure 1:
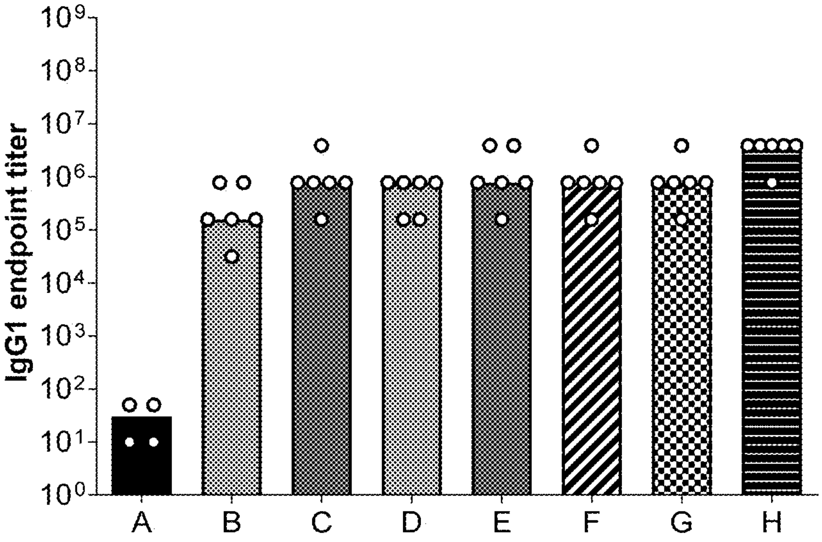
Figure 1:
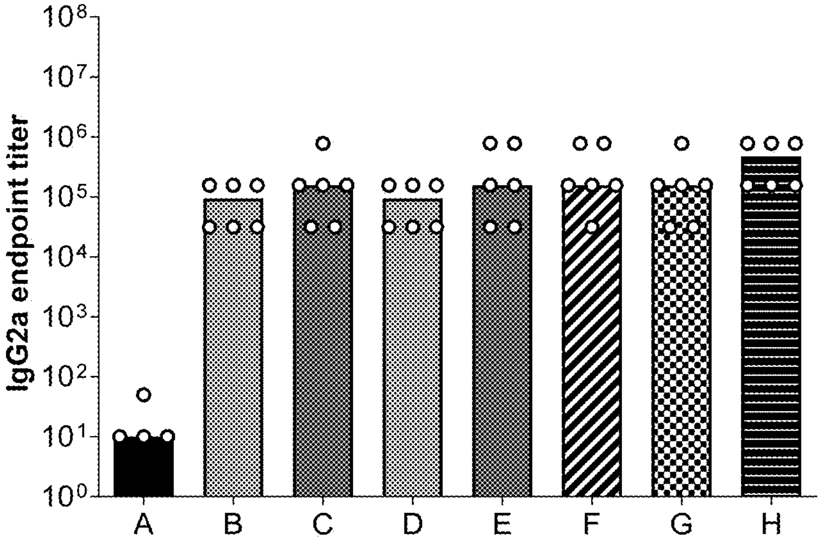
Figure 1:
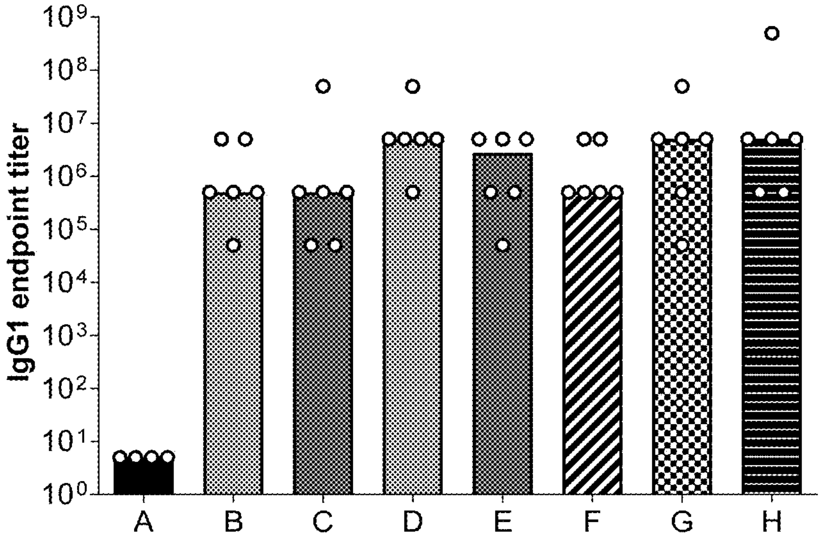
Figure 1:
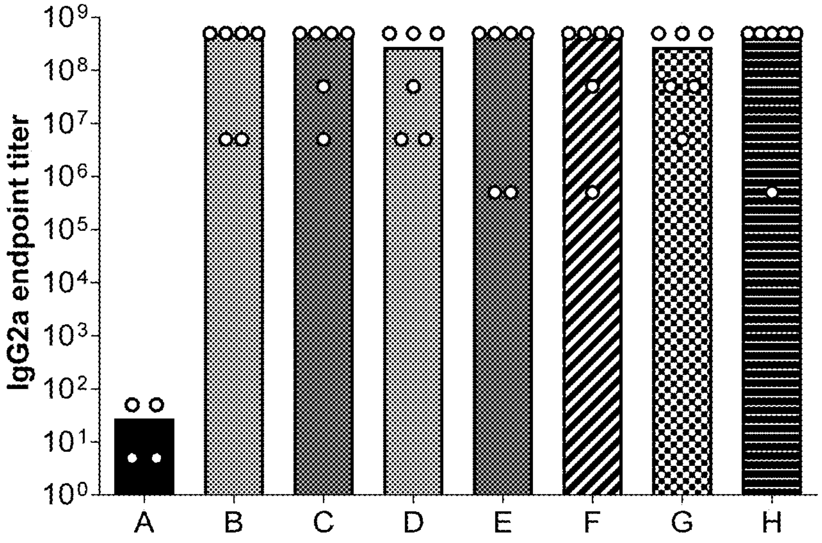
Figure 1:
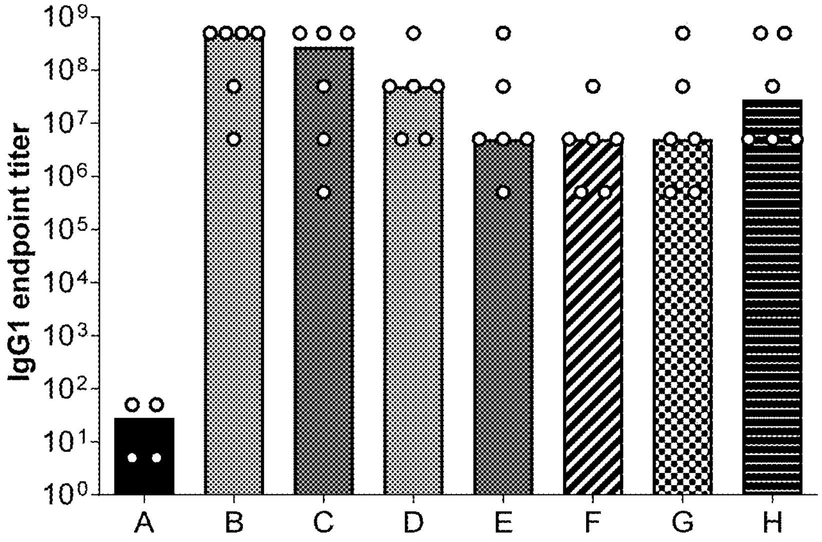
Figure 1:
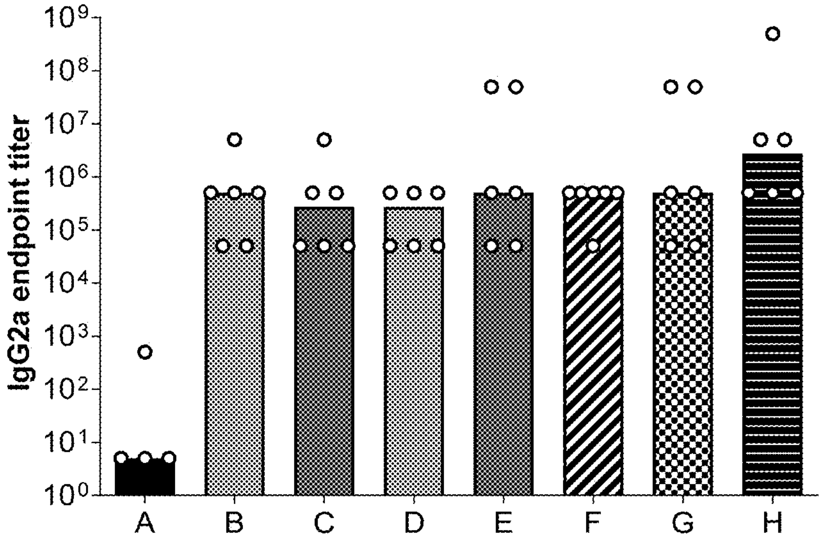

Results:

As shown in FIG. 1 significant IgG1 and IgG2a binding antibody responses to the receptor binding domain (RBD) of ancestral SARS-CoV-2 and the RBD of the B.351 variant on day 14 (FIG. 1A-D) and on day 21 (FIG. 1 E-H) were detected for the group vaccinated with the CV2CoV and CV2CoV.351. On day 14, as shown in FIG. 1A, comparable IgG1 response for all groups (ancestral receptor binding domain (RBD) protein coating) and comparable IgG2a titers (FIG. 1 B) for all groups were detected (ancestral SARS-CoV-2 receptor binding domain (RBD) protein coating). On day 14, shown in FIG. 1 C, comparable IgG1 response for all vaccination designs (RBD B.1.351 variant K417N, E484K, N501Y protein coating) and comparable IgG2a titers (FIG. 1 D) for all vaccination designs were detected (RBD B.1.351 variant K417N, E484K, N501Y protein coating). On day 21, as shown in FIG. 1 E, comparable IgG1 response for all vaccination designs (ancestral SARS-CoV-2 receptor binding domain (RBD) protein coating) and comparable IgG2a titers (FIG. 1 F) for all vaccination designs were detected (ancestral SARS-CoV-2 receptor binding domain (RBD) protein coating). On day 21, as shown in FIG. 1 G, comparable IgG1 response for all vaccination designs (RBD B.1.351 variant K417N, E484K, N501Y protein coating) and comparable IgG2a titers (FIG. 1 H) for all vaccination designs were shown (RBD B.1.351 variant K417N, E484K, N501Y protein coating). Overall, CV2CoV and CV2CoV.351 given alone (group B-C), in sequential combination or (group D-E) and as co-deliveries of both vaccine variants (bivalent vaccine CV2CoV/CV2CoV.351) in one and two LNPs, injected in the same leg or different legs (group F-H) induced comparable levels of binding antibodies to the ancestral SARS-CoV-2 RBD and the RBD of the B.1.351 variant.

Figure 2:
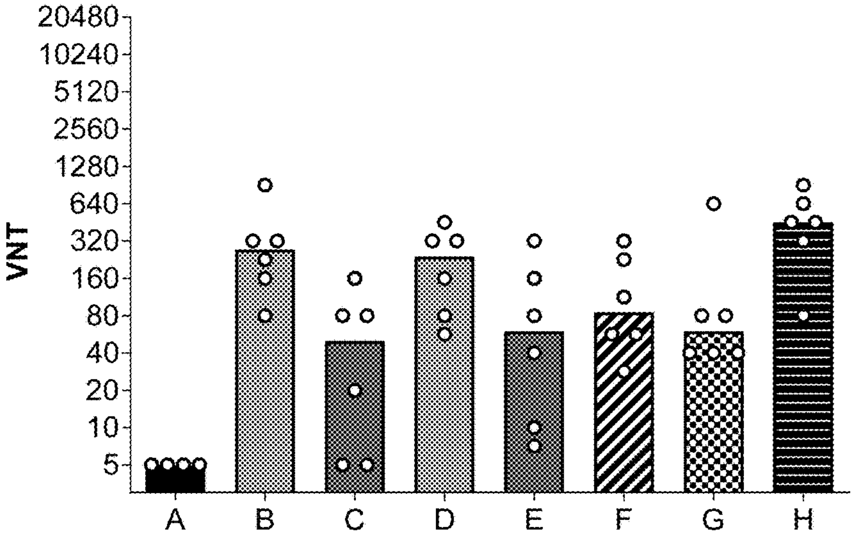
FIG. 2 shows significant induction of virus neutralizing titers (VNTs) assessed in a cytopathic effect (CPE)-based assay using ancestral SARS-CoV-2.
Figure 2:
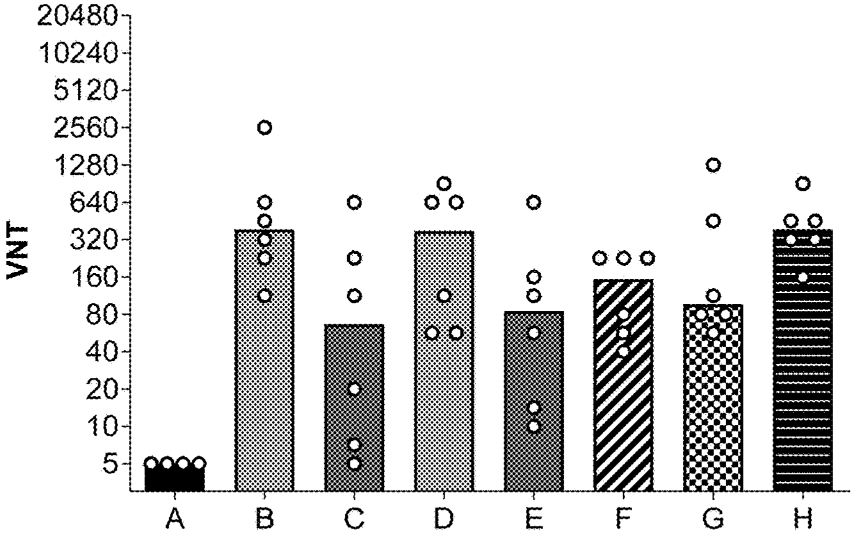
Figure 2:
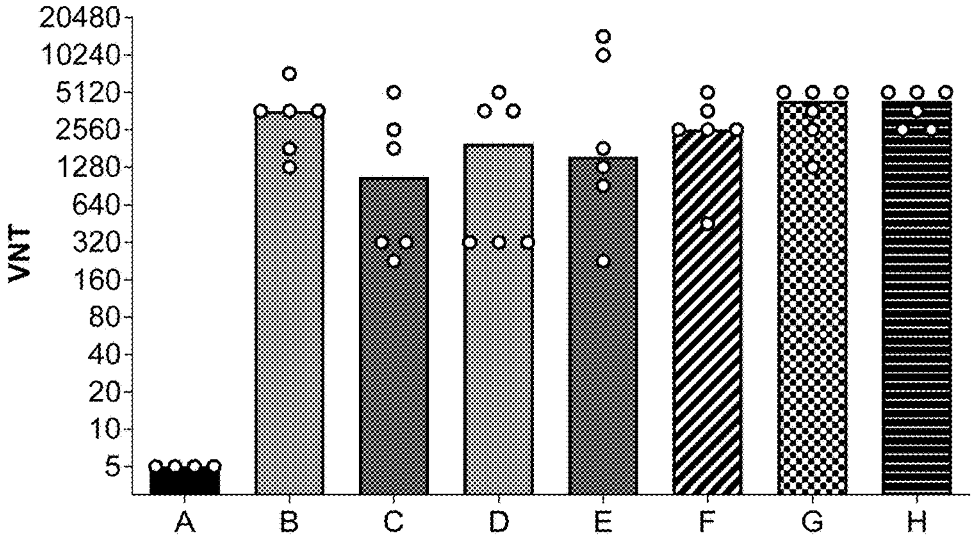

As shown in FIG. 2A (day 14) and 2 B (day 21) the vaccination with CV2CoV and CV2CoV.351 induced significant levels of VNTs against ancestral SARS-CoV-2 in rats (group B—H). Overall, vaccination with either vaccine alone or in combination (group B—H) generated high VNT levels. Especially two vaccinations with CV2CoV in in group B, sequential vaccination with CV2CoV and CV2CoV.351 in group D and co-delivery of both vaccine variants (bivalent vaccine CV2CoV/CV2CoV.351) into different legs (group H) showed increased VNTs at these early time points. On day 42, increased levels of VNT were detected for all groups (group B—H) (FIG. 2 C). The bivalent vaccines (group F-H) induced responses that were comparable to the monovalent vaccines (groups B-E) despite using lower doses of each vaccine on day 42.

Figure 3:
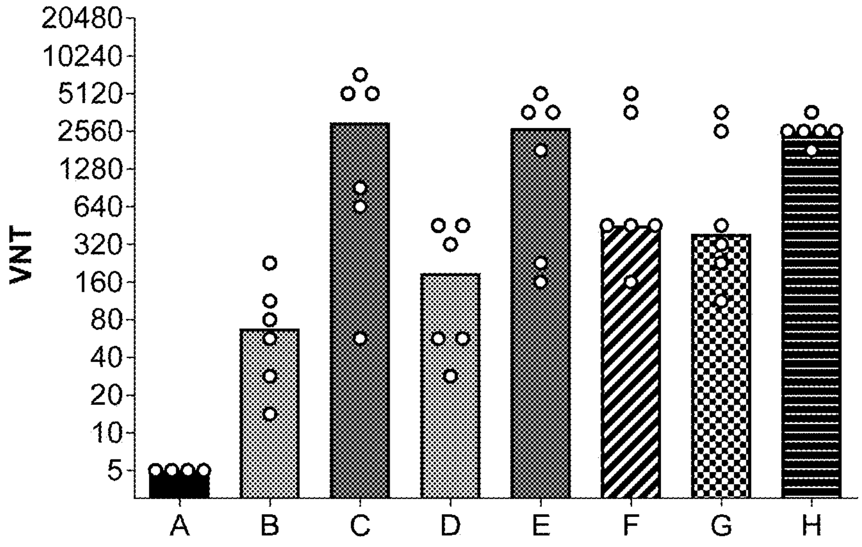
FIG. 3 shows significant induction of VNTs) assessed in a CPE-based assay using B.1.351 variant SARS-CoV-2.
Figure 3:
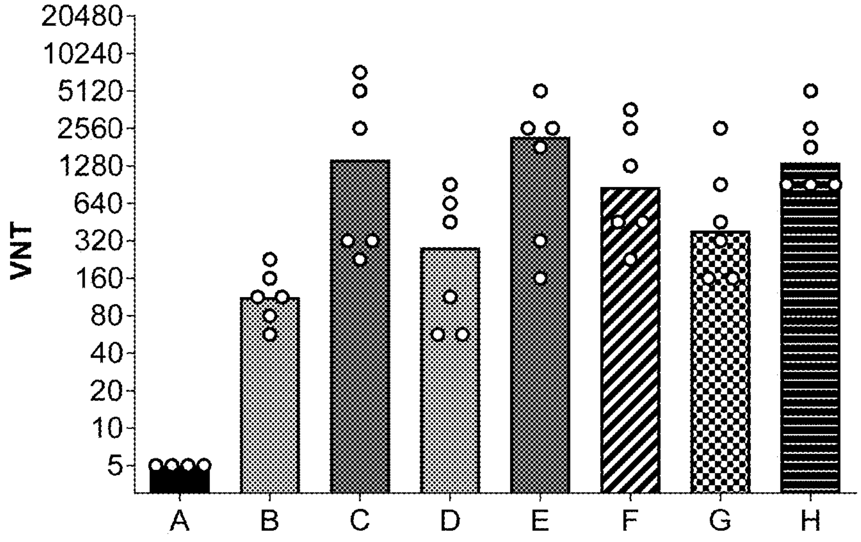
Figure 3:
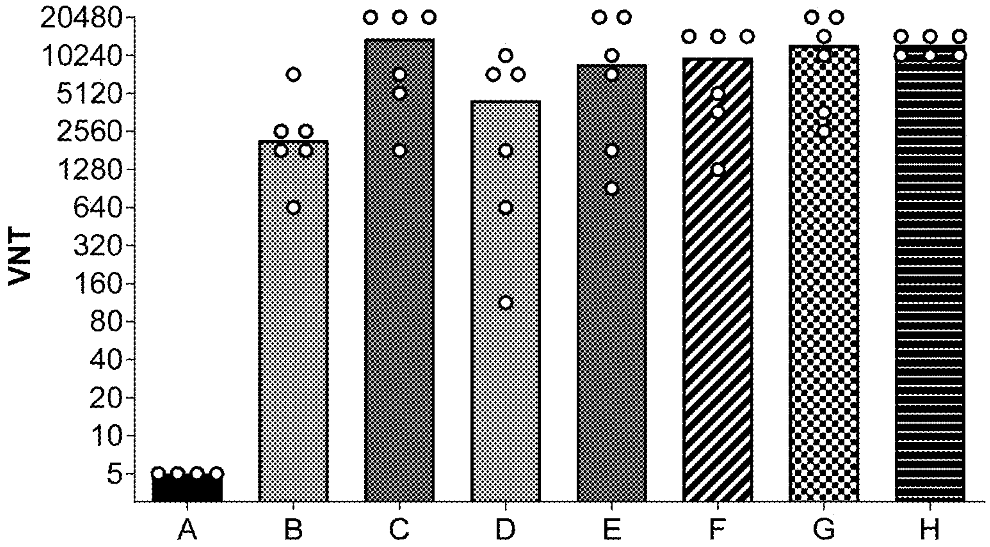

As shown in FIG. 3A (day 14) and 3 B (day 21) the vaccination with CV2CoV and CV2CoV.351 induced significant levels of VNTs against B.1.351 variant SARS-CoV-2 (group B—H). Overall, vaccination with either vaccine alone or in combination (group B—H) generated sufficient VNT levels. Two vaccinations with CV2CoV.351 in group C, sequential vaccination with CV2CoV.351 and CV2CoV in group E and co-delivery of both vaccine variants (bivalent vaccine CV2CoV/CV2CoV.351) into different legs (group H) showed increased VNTs at early time points. On day 42, increased levels of VNTs were shown for all groups (group B—H) (FIG. 3 C). The bivalent vaccines (group F-H) induced responses that were comparable to the monovalent vaccines (groups B-E) despite using lower doses of each vaccine on day 42.

Figure 4:
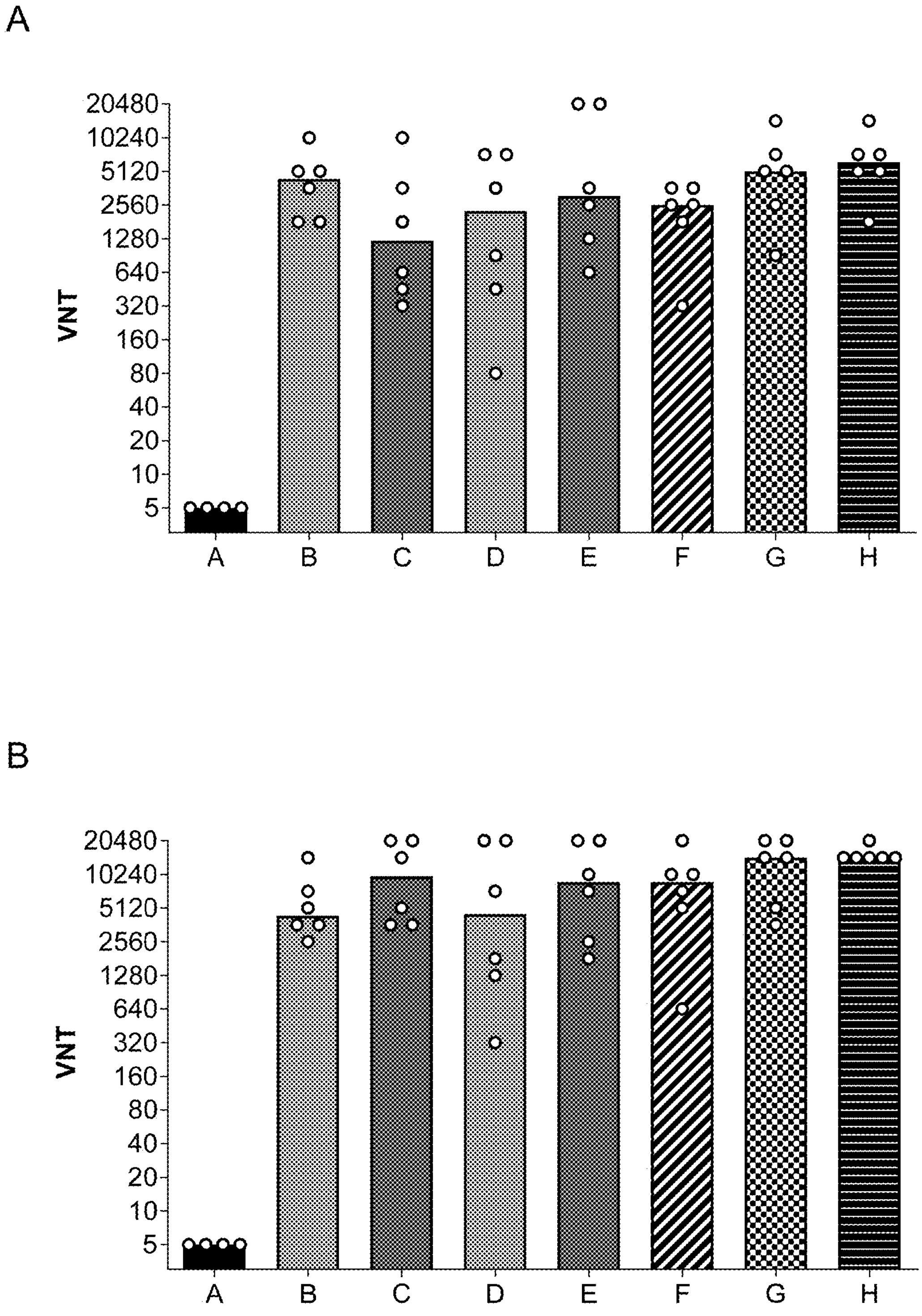
FIG. 4 shows significant induction of VNTs assessed in a CPE-based assay using B.1.1.7 variant SARS-CoV-2 (FIG. 4A) or P.1 (B.1.1.28) (FIG. 4 B).

As shown in FIG. 4 significant induction of VNTs assessed in a CPE-based assay for all groups (group B—H) using B.1.1.7 variant SARS-CoV-2 (FIG. 4A) or B.1.1.28 P.1 (FIG. 4 B) were detected on day 42. Co-delivery of both vaccine variants into the same leg (group F and G) or into different legs (group H) can generate responses against both variants on day 42. Table 7 summarizes median VNTs against ancestral, B.1.1.7, B.1.351 and P1 SARS-CoV-2 variants on day 42.

TABLE 7

Median VNTs (day 42)

| Group | VNTs ancestral | VNTs B.1.1.7 | VNTs B.1.351 | VNTs P.1 |
|---|---|---|---|---|
| A | 5 | 5 | 5 | 5 |
| B | 3620 | 4370 | 2185 | 4370 |
| C | 1065 | 1225 | 13860 | 9801 |
| D | 1970 | 2263 | 4526 | 4526 |
| E | 1545 | 3090 | 8740 | 8740 |
| F | 2560 | 2560 | 9801 | 8740 |
| G | 4370 | 5120 | 12361 | 14481 |
| H | 4370 | 6180 | 12361 | 14481 |

Overall, the bivalent vaccine elicited robust levels of both RBD binding and virus neutralizing antibodies that were able to neutralize both ancestral and B.1.351 SARS-CoV-2 as well as the variants B.1.1.7 and B.1.1.28 P.1.

Example 3: Dose Response Study: Immunogenicity of CV2CoV.351 in Comparison to CV2CoV Upon i.m. Administration in Wistar Rats The objective of this study was to assess immunogenicity and early innate stimulation of the CV2CoV.351 vaccine in rats in a dose-response study.

Preparation of LNP Formulated mRNA Vaccine:

SARS-CoV-2 mRNA constructs (CV2CoV-LNP formulated mRNA based SARS-CoV-2 vaccine encoding for full length, pre-fusion stabilized ancestral SARS-CoV-2 S and CV2CoV.351-LNP formulated mRNA based SARS-CoV-2 vaccine encoding for full length, pre-fusion stabilized SARS-CoV-2 B.1.351 S) were prepared as described in Example 1.2 (RNA in vitro transcription). HPLC purified mRNA was formulated with LNPs according to Example 1.4 prior to use in in vivo vaccination experiments.

Immunization:

Rats were injected intramuscularly (i.m.) with mRNA vaccine compositions and doses as indicated in Table 8. Buffer vaccinated animals served as a negative control (group A). All animals were vaccinated on day 0 and day 21. Blood samples were collected day 14, day 21 and day 42 for the determination of antibody titers.

TABLE 8

Vaccination regimen (Example 3)

| Group | Animals | Vaccine | mRNA Dose | i.m. vacci-nation | Blood collection |
|---|---|---|---|---|---|
| A | Wistar Female N = 4 | Neg. Ctrl (Buffer) | / | D 0, D 21 | D 14, D 21, D 42 |
| B | Wistar Female N = 6 | CV2CoV.351 (B.1.351 Variant S) | 0.5 μg | | |
| C | | | 2 μg | | |
| D | | | 8 μg | | |
| E | | | 40 μg | | |
| F | | CV2CoV (ancestral S) | 0.5 μg | | |
| G | | | 2 μg | | |
| H | | | 8 μg | | |
| I | | | 40 μg | | |

CV2CoV is shown as R9709 in Table 4 and CV2CoV.351 is shown as R10384 in Table 4

Determination of IgG1 and IgG2 spike-binding antibody titers using ELISA and determination of VNTs were performed as described in Example 2.

Results:

Antigen-specific binding antibody titers (analyzed via ELISA) and VNTs against both ancestral and B.1.351 SARS-CoV-2 were detectable in a dose dependent manner in animals vaccinated with both vaccines. Binding as well as neutralizing antibodies increased over time and with increasing the dose.

Figure 5:
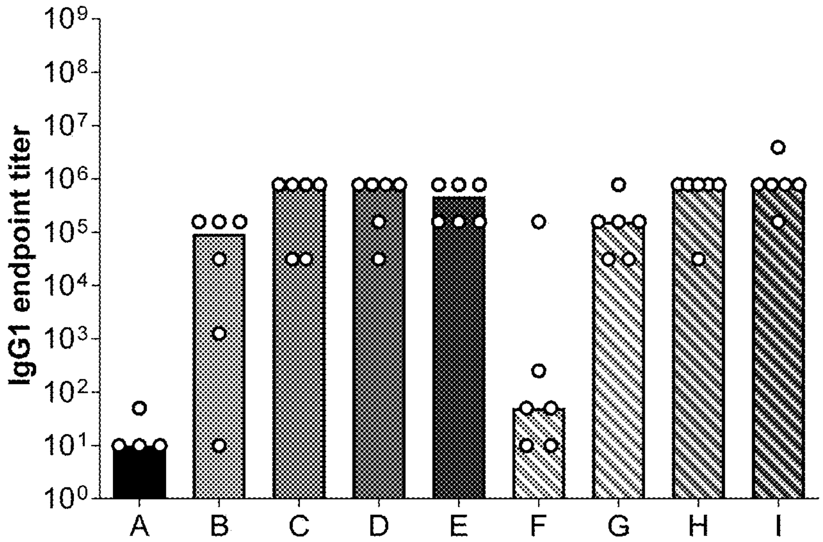
FIG. 5 shows significant IgG1 and IgG2a binding antibody responses on day 14 (FIG. 5A-D) and on day 21 (FIG. 5 E-H) for the groups vaccinated with CV2CoV and CV2CoV.351. On day 14, FIGS. 5A (IgG1 titer) and 5 B (IgG2a titer) show dose-dependent levels of binding antibody titers using doses of 0.5 μg, 2 μg, 8 μg and 40 μg and reached saturation in the groups vaccinated with 40 μg (ancestral SARS-CoV-2 receptor binding domain (RBD) protein coating). On day 14, FIG. 5 C (IgG1 titer) and 5 D (IgG2a titer) show dose-dependent levels of binding antibody titers using doses of 0.5 μg, 2 μg, 8 μg and 40 μg and reached saturation in groups vaccinated with 40 μg (RBD B.1.351 variant K417N, E484K, N501Y protein coating). On day 21, FIG. 5 E (IgG1 titer) and 5 F (IgG2a titer) show a dose-dependent levels of binding antibody titer and saturated IgG1 titer and IgG2a titer for the CV2CoV.351 vaccination for all amounts and a saturation for amounts >8 μg (group I) for CV2CoV (ancestral SARS-CoV-2 receptor binding domain (RBD) protein coating). On day 21, FIG. 5 G (IgG1 titer) and 5 H (IgG2a titer) showdose-dependent levels of binding antibody titer and saturated IgG1 and IgG2a titers upon vaccination with CV2CoV.351 for all amounts and a saturation for amounts >8 μg (group I) for the mRNA vaccine the CV2CoV (RBD B.1.351 variant K417N, E484K, N501Y protein coating).
Figure 5:
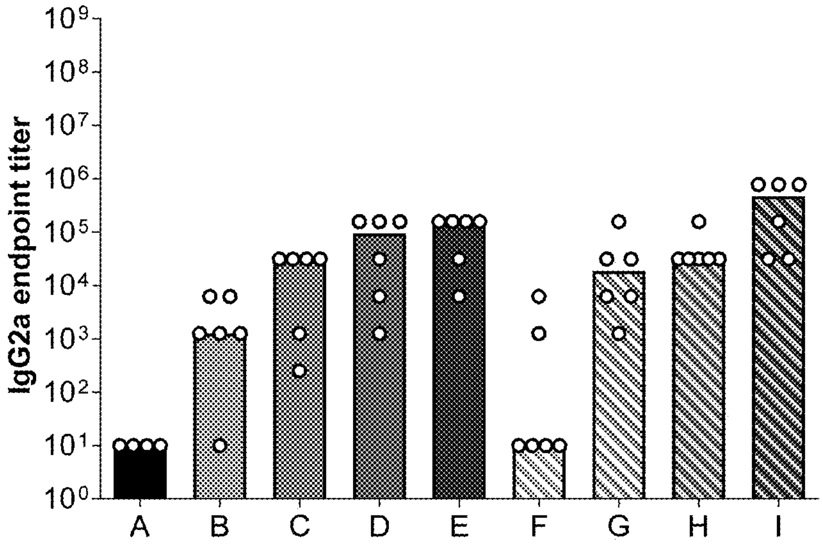
Figure 5:
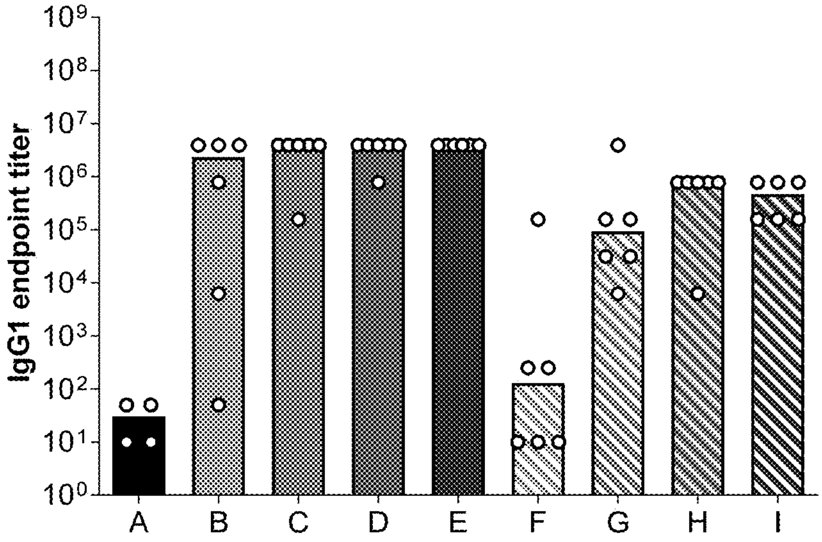
Figure 5:
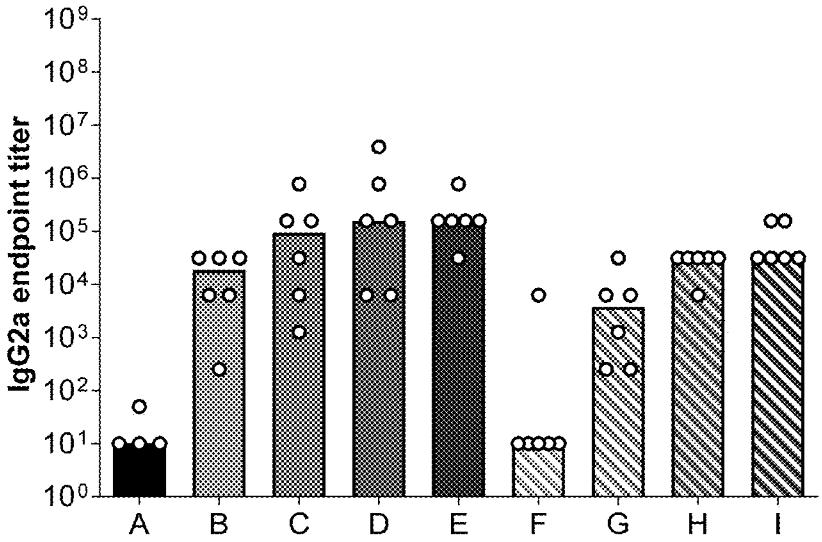
Figure 5:
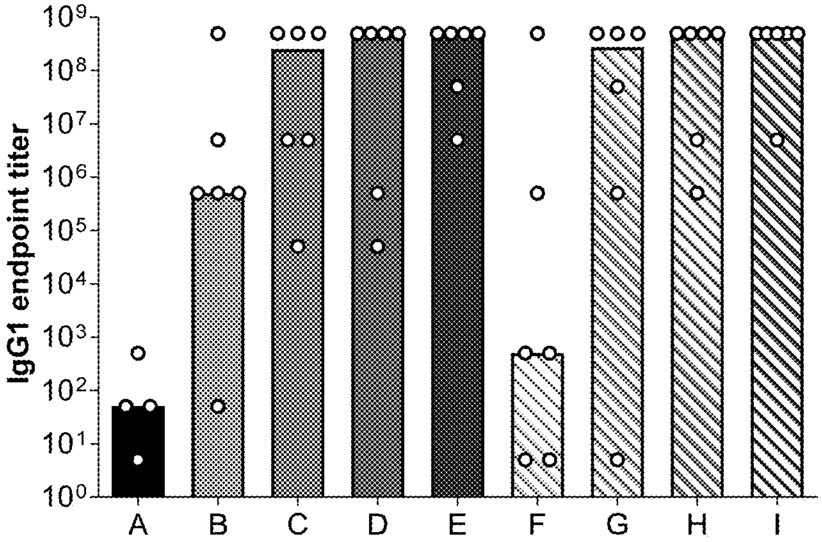
Figure 5:
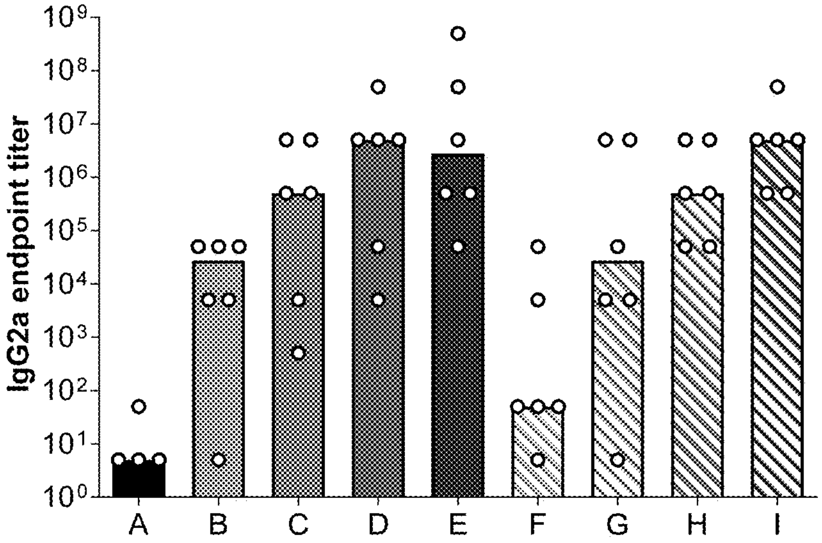
Figure 5:
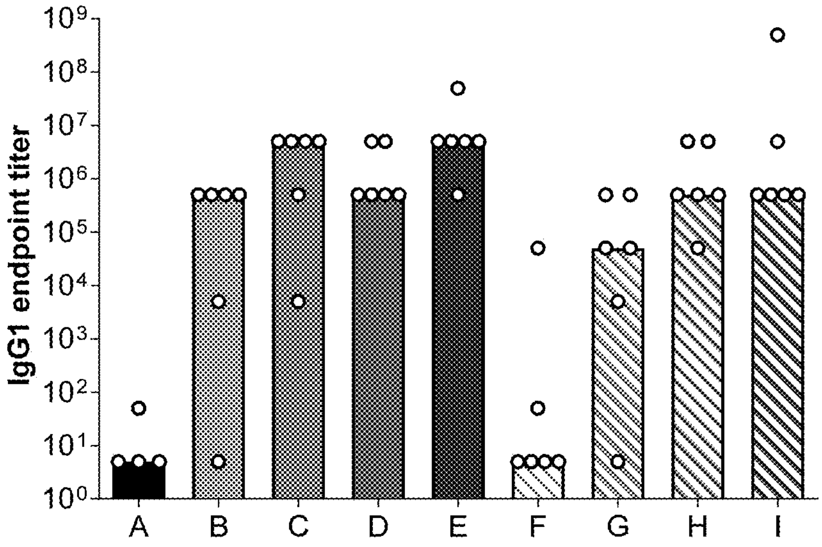
Figure 5:
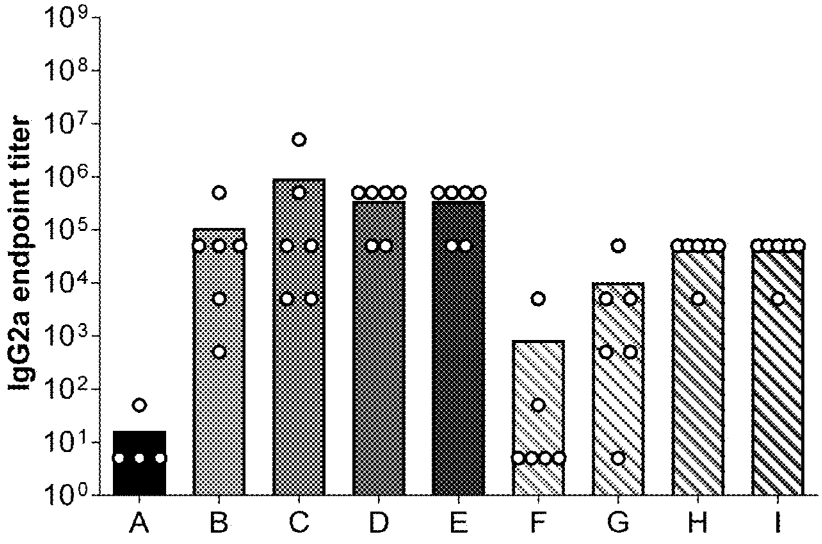

As shown in FIGS. 5A (IgG1) and 5 B (IgG2a) (ancestral SARS-CoV-2 RBD coating) and 5 C (IgG1) and 5 D (IgG2a) (B.1.351 variant RBD K417N, E484K, N501Y coating) vaccination with CV2CoV (group B-E) and CV2CoV.351 (group F-I) induced spike-binding antibody titers using doses of 0.5 μg, 2 μgn 8 μg and 40 μg in rats on day 14. As shown in FIG. 5 E (IgG1), FIG. 5 F (IgG2a) (ancestral SARS-CoV-2 RBD coating) and FIG. 5 G (IgG1) and 5 H (IgG2a) (B.1.351 variant RBD K417N, E484K, N501Y coating) vaccination with CV2CoV (group B-E) and CV2CoV.351 (group F-I) induced spike-binding antibody titers in rats using doses of 0.5 μg, 2 μg and 8 μg and 40 μg on day 21.

Figure 6:
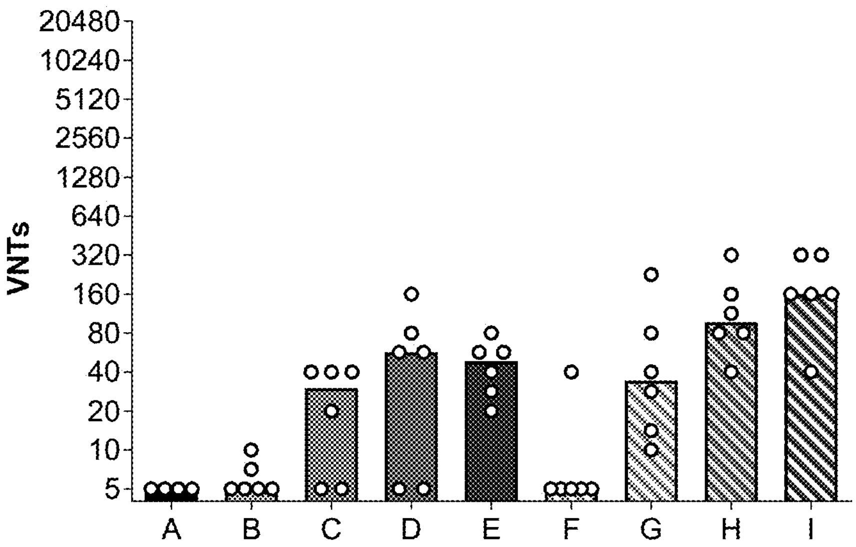
FIG. 6 shows significant induction of VNTs assessed in a CPE-based assay using ancestral SARS-CoV-2 (CV2CoV, FIGS. 6A, 6 C and 6 E) or B.1.351 variant SARS-CoV-2 (CV2CoV.351, FIGS. 6 B, 6 D and 6 F) on day 14, day 21 and day 42.
Figure 6:
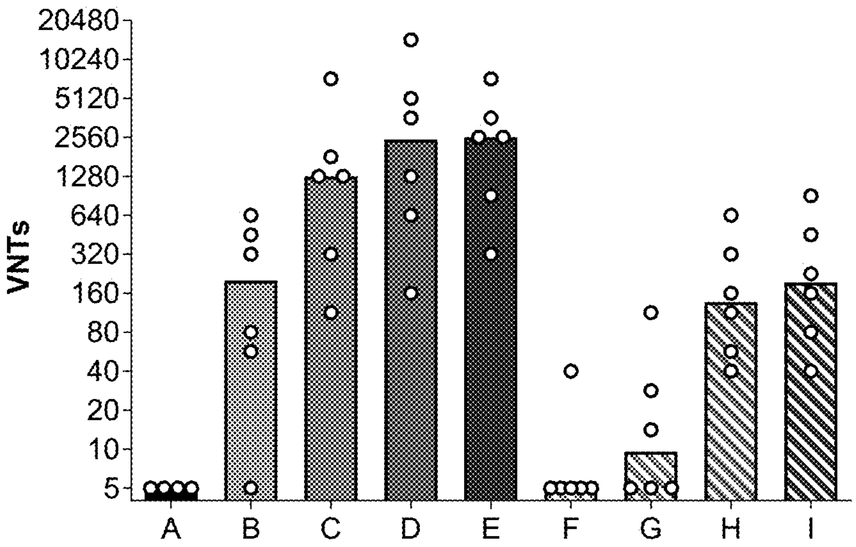
Figure 6:
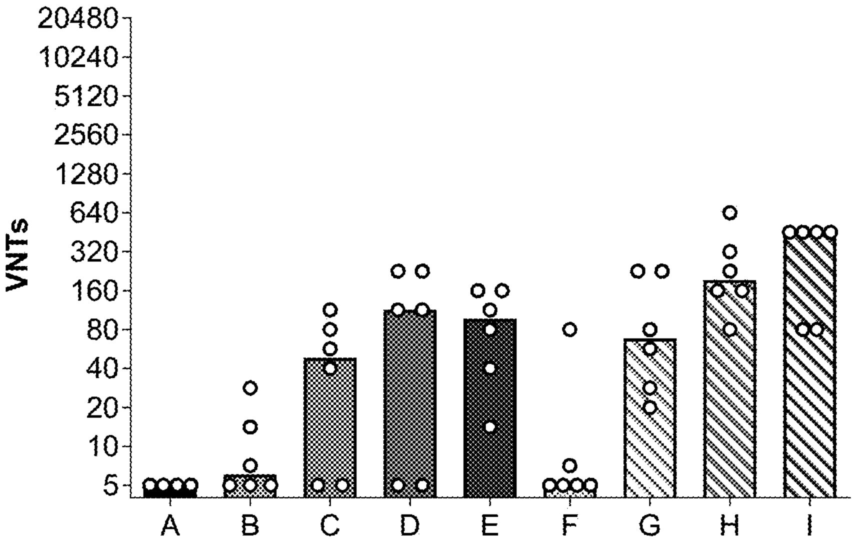
Figure 6:
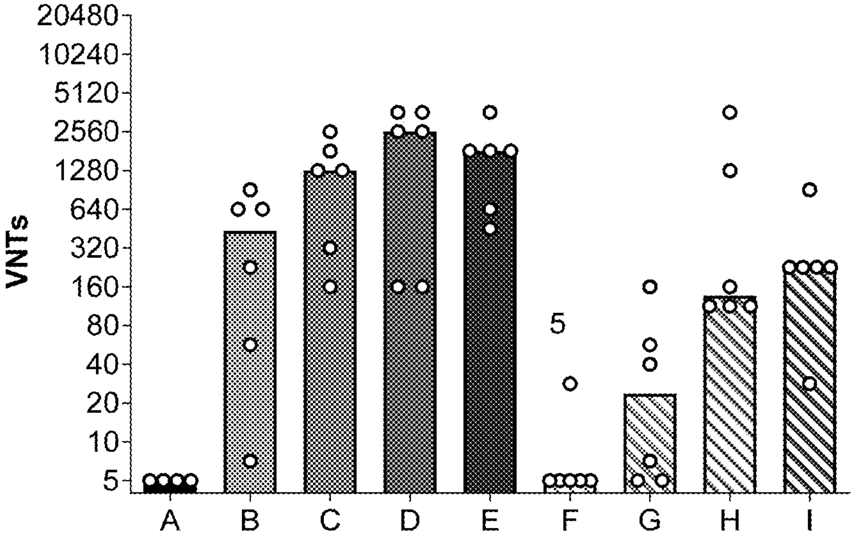
Figure 6:
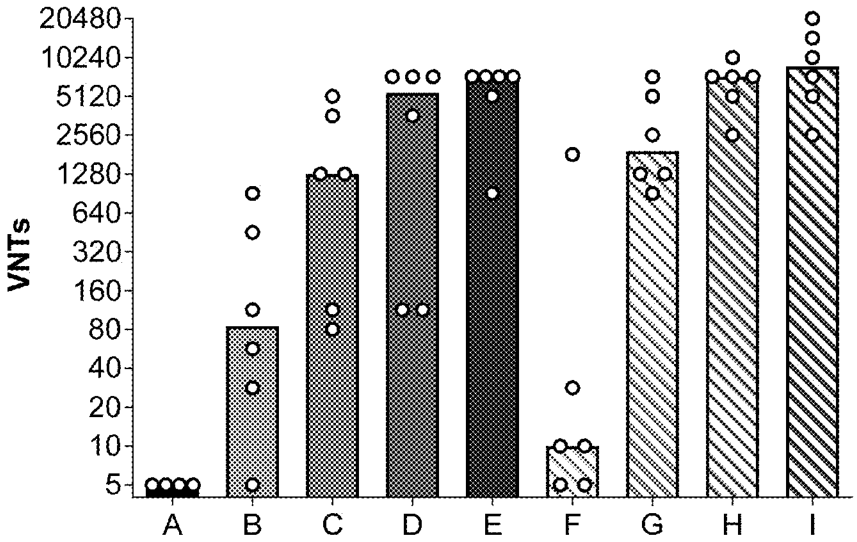
Figure 6:
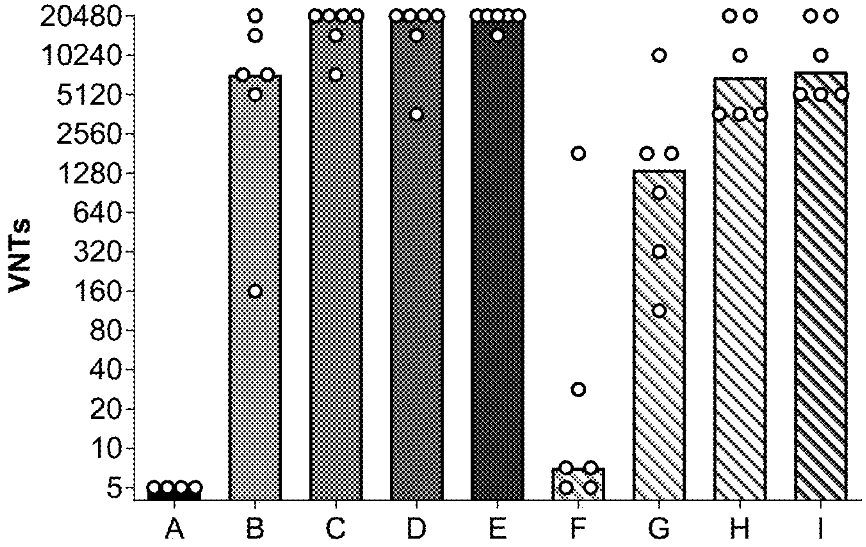
Figure 6:
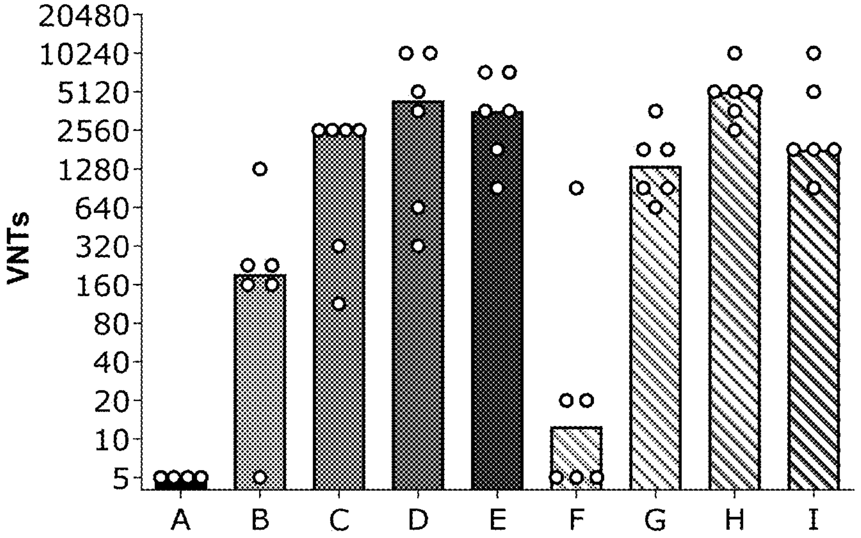
Figure 6:
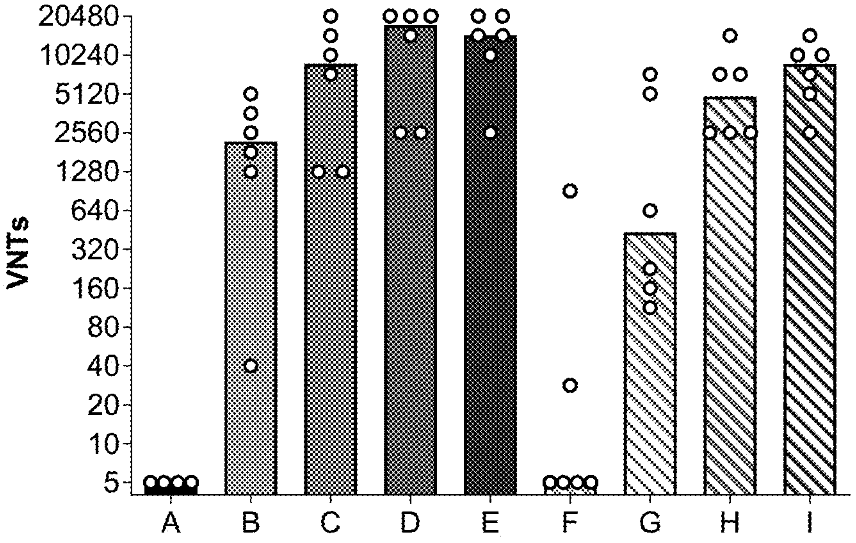

As shown in FIG. 6A the B.1.351 variant vaccine CV2CoV.351 (group B-E) induced dose-dependent VNTs against ancestral SARS-CoV-2 (heterologous response) on day 14 in all dose groups. Compared to responses upon vaccination with CV2CoV (homologous response), VNTs in CV2CoV.351 vaccinated groups are decreased by a factor of approx. 2 on day 14. FIG. 6 B shows that CV2CoV.351 (group B-E) induces dose-dependent VNTs against B.1.351 SARS-CoV-2 (homologous response) on day 14 in all dose groups. CV2CoV.351 vaccination elicited high levels of VNTs against homologous virus that were 45× increased on day 14, compared to heterologous VNTs against ancestral virus (average difference of all dose groups). In comparison to vaccination with CV2CoV (group F-I), VNTs induced by CV2CoV.351 were increased by a factor of 41 on day 14 (average difference of all dose groups). As shown in FIG. 6 C the B.1.351 variant vaccine CV2CoV.351 (group B-E) induced dose-dependent VNTs against ancestral SARS-CoV-2 (heterologous response) on day 21 in all dose groups. Compared to responses upon vaccination with CV2CoV (homologous response), VNTs in CV2CoV.351 vaccinated groups are decreased by a factor of approx. 2 on day 21. As shown in FIG. 6 D CV2CoV.351 induces slightly dose-dependent VNTs against B.1.351 SARS-CoV-2 (homologous response) on day 21 in all dose groups. CV2CoV.351 vaccination elicited high levels of VNTs against homologous virus that were 35× increased on day 21, compared to heterologous VNTs against ancestral virus (average difference of all dose groups). In comparison to vaccination with CV2CoV, VNTs induced by CV2CoV.351 were increased by a factor of 42 on day 21 (average difference of all dose groups). As shown in FIG. 6 E the B.1.351 variant vaccine CV2CoV.351 induced VNTs against ancestral SARS-CoV-2 (heterologous response) on day 41 in all dose groups. Slightly higher responses except for 0.5 μg dose group (group F) were shown upon vaccination with CV2CoV (homologous response). As shown in FIG. 6 F CV2CoV.351 induced VNTs against B.1.351 SARS-CoV-2 (homologous response) on day 42 in all dose groups. In comparison to vaccination with CV2CoV, VNTs induced by CV2CoV.351 were increased on day 42. As shown in FIG. 6 G the B.1.351 variant vaccine CV2CoV.351 induced VNTs against B.1.1.7 variant SARS-CoV-2 (heterologous response) on day 42 in all dose groups. Similar responses were shown upon vaccination with CV2CoV (heterologous response). As shown in FIG. 6 H CV2CoV.351 induced VNTs against or B.1.1.28 P.1 SARS-CoV-2 (homologous response) on day 42 in all dose groups. Lower responses were detected upon vaccination with CV2CoV (heterologous response).

Overall, the SARS-CoV-2 B.1.351 variant mRNA vaccine candidate CV2CoV.351 induced robust humoral immune responses in rats, as determined by binding and virus neutralizing antibody titers. Virus neutralizing titers against B.1.351 were substantially increased upon vaccination with CV2CoV.351 compared to vaccination with CV2CoV.

Example 4: Extended Multivalency Vaccination Study: Immunogenicity of a Bivalent CV2CoV and CV2CoV.351 Vaccine Upon i.m. Administration in Wistar Rats (Prophetic)

The objective of this study is to assess immunogenicity and early innate stimulation of the bivalent CV2CoV/CV2CoV.351 vaccine in a third vaccination in rats.

Preparation of LNP Formulated mRNA Vaccine:

SARS-CoV-2 mRNA constructs (CV2CoV-LNP formulated mRNA based SARS-CoV-2 vaccine encoding for full length, pre-fusion stabilized ancestral SARS-CoV-2 S and CV2CoV.351-LNP formulated mRNA based SARS-CoV-2 vaccine encoding for full length, pre-fusion stabilized SARS-CoV-2 B.1.351 S) are prepared as described in Example 1.2 (RNA in vitro transcription). HPLC purified mRNA is formulated with LNPs according to Example 1.4 and Example 1.5 (separately mixed or formulated for bivalent mRNA vaccines) prior to use in in vivo vaccination experiments.

Immunization:

Rats are injected intramuscularly (i.m.) with mRNA vaccine compositions and doses as indicated in Table 9. Buffer vaccinated animals serve as a negative control (group A). All animals are vaccinated on week 0, week 3 (day 21) and for group B additionally on week 15 (day 105). Blood samples are collected on day 0, day 14, day 21, day 42, day 77, day 105, day 119 and day 133 for the determination of antibody titers.

TABLE 9

Vaccination regimen (Example 4)

| Group | Animals | 1st vaccination week 0 | 2nd vaccination week 3 | 3rd vaccination week 15 | Serum isolation |
|---|---|---|---|---|---|
| A | N = 4 | NaCl | NaCl | NaCl | D 0 (18 h), |
| B | Wistar Female N = 6 | CV2CoV 8 μg | CV2CoV 8 μg | CV2CoV + CV2CoV.351 8 μg (mixed 2 LNPs) | Week 2 (D 14) Week 3 (D 21) Week 6 (D 42) |
| C | | CV2CoV.351 8 μg | CV2CoV.351 8 μg | | Week 11 (D 77) Week 15 (D 105) |
| D | | CV2CoV 8 μg | CV2CoV.351 8 μg | | Week 17 (D 119) Week 19 (D 133) |
| E | | CV2CoV.351 8 μg | CV2CoV.351 8 μg | | |
| F | | CV2CoV+ CV2CoV.351 mixed 1 LNP 8 μg | CV2CoV + CV2CoV.351 mixed 1 LNP 8 μg | | |
| G | | CV2CoV + CV2CoV.351 mixed 2 LNPs 8 μg | CV2CoV+ CV2CoV.351: mixed 2 LNPs 8 μg | | |
| H | | CV2CoV (left leg) 4 μg CV2CoV.351 (right leg) 4 μg | CV2CoV (left leg) 4 μg CV2CoV.351 (right leg) 4 μg | | |

CV2CoV is shown as R9709 in Table 4 and CV2CoV.351 is shown as R10384 in Table 4

Determination of IgG1 and IgG2 spike-binding antibody titers using ELISA and determination of VNTs are performed as described in Example 2.

Example 5: Co-Delivery of Vaccines: Vaccination of Rats with mRNA Encoding Ancestral SARS-CoV2 Antigen (CV2CoV) and SARS-CoV2 Antigen of Variant B.1.351 (CV2CoV.351)

Within this study, the antibody response against both ancestral and B.1.351 SARS-CoV-2 were measured.

Preparation of LNP Formulated mRNA Vaccine:

SARS-CoV-2 mRNA constructs (CV2CoV-mRNA based SARS-CoV-2 vaccine encoding for full length, pre-fusion stabilized ancestral SARS-CoV-2 S and CV2CoV.351-mRNA based SARS-CoV-2 vaccine encoding for full length, pre-fusion stabilized SARS-CoV-2 B.1.351 S) were prepared as described in Example 1.2 (RNA in vitro transcription). HPLC purified mRNA was formulated with LNPs according to Example 1.4 and Example 1.5 (separately mixed or formulated for bivalent mRNA vaccines) prior to use in in viva Immunization:

Rats were injected intramuscularly (i.m.) with mRNA vaccine compositions and doses as indicated in Table 10. As a negative control, one group of rats was vaccinated with buffer (group A). All animals were vaccinated on week 0 and week 3 (day 21). Blood samples were collected on day 0, day 14, day 21, and day 42 for the determination of antibody titers.

TABLE 10

Vaccination regimen (Example 5)

| Group | Animals | 1st vaccination week 0 | 2nd vaccination week 3 | Immunisation schedule | Serum isolation |
|---|---|---|---|---|---|
| A | Wistar Female N = 4 | NaCl | NaCl | Week 0 Week 3 | D 0 (18 h), Week 2 (D 14) Week 3 (D 21) Week 6 (D 42) |
| B | Wistar Female N = 6 | CV2CoV + CV2CoV.351 8 µg | CV2CoV + CV2CoV.351 8 µg | | |
| C | | CV2CoV + CV2CoV.351 2 µg | CV2CoV + CV2CoV.351 2 µg | | |
| D | | CV2CoV + CV2CoV.351 0.5 µg | CV2CoV + CV2CoV.351 0.5 µg | | |

CV2CoV is shown as R9709, CV2CoV.351 as R10384 in Table 4

Determination of IgG1 and IgG2a spike-binding antibody titers using ELISA and determination of VNTs were performed as described in Example 2.

Figure 7:
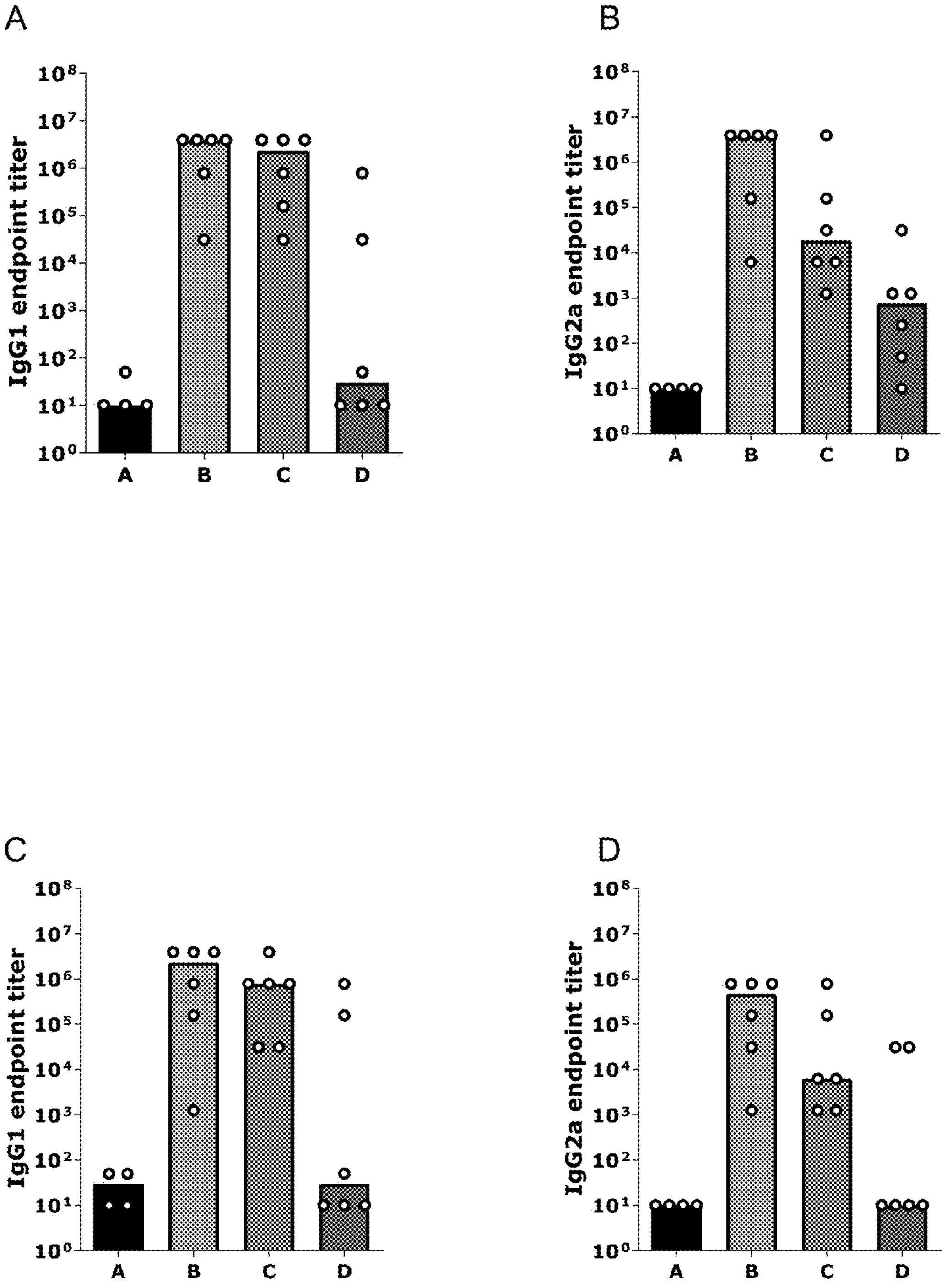
FIG. 7 shows significant IgG1 and IgG2a binding antibody responses on day 14 (FIG. 7A-D) for the groups vaccinated with bivalent mRNA vaccine composition CV2CoV+CV2CoV.351 formulated in LNPs. On day 14, FIGS. 7A (IgG1 titer) and 7 B (IgG2a titer) show dose-dependent levels of binding antibody titers using doses of 0.5 μg, 2 μg and 8 μg (SARS-CoV-2 ancestral receptor binding domain (RBD) protein coating). On day 14, FIGS. 7 C (IgG1 titer) and 7 D (IgG2a titer) show dose-dependent levels of binding antibody titers using doses of 0.5 μg, 2 μg and 8 μg (B.1.351 RBD variant K417N, E484K, N501Y protein coating). Significant induction of VNTs assessed in a CPE-based assay is shown using ancestral SARS-CoV-2 (FIGS. 7 E, 7 F and 7 I) or B.1.351 variant SARS-CoV-2 (FIGS. 7 G, 7 H and 7 J) on day 14, day 21 and day 42 respectively.
Figure 7:
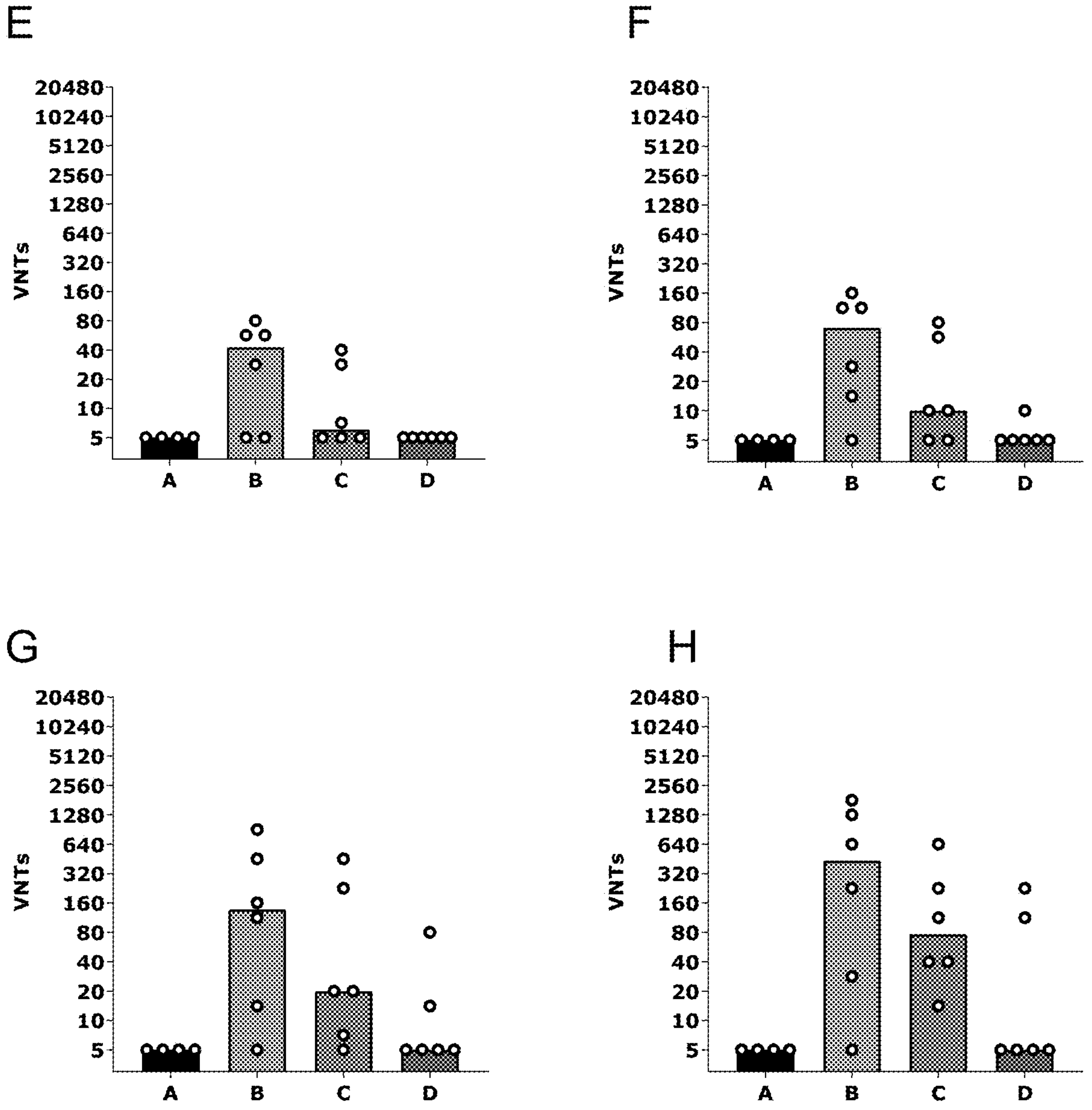
Figure 7:
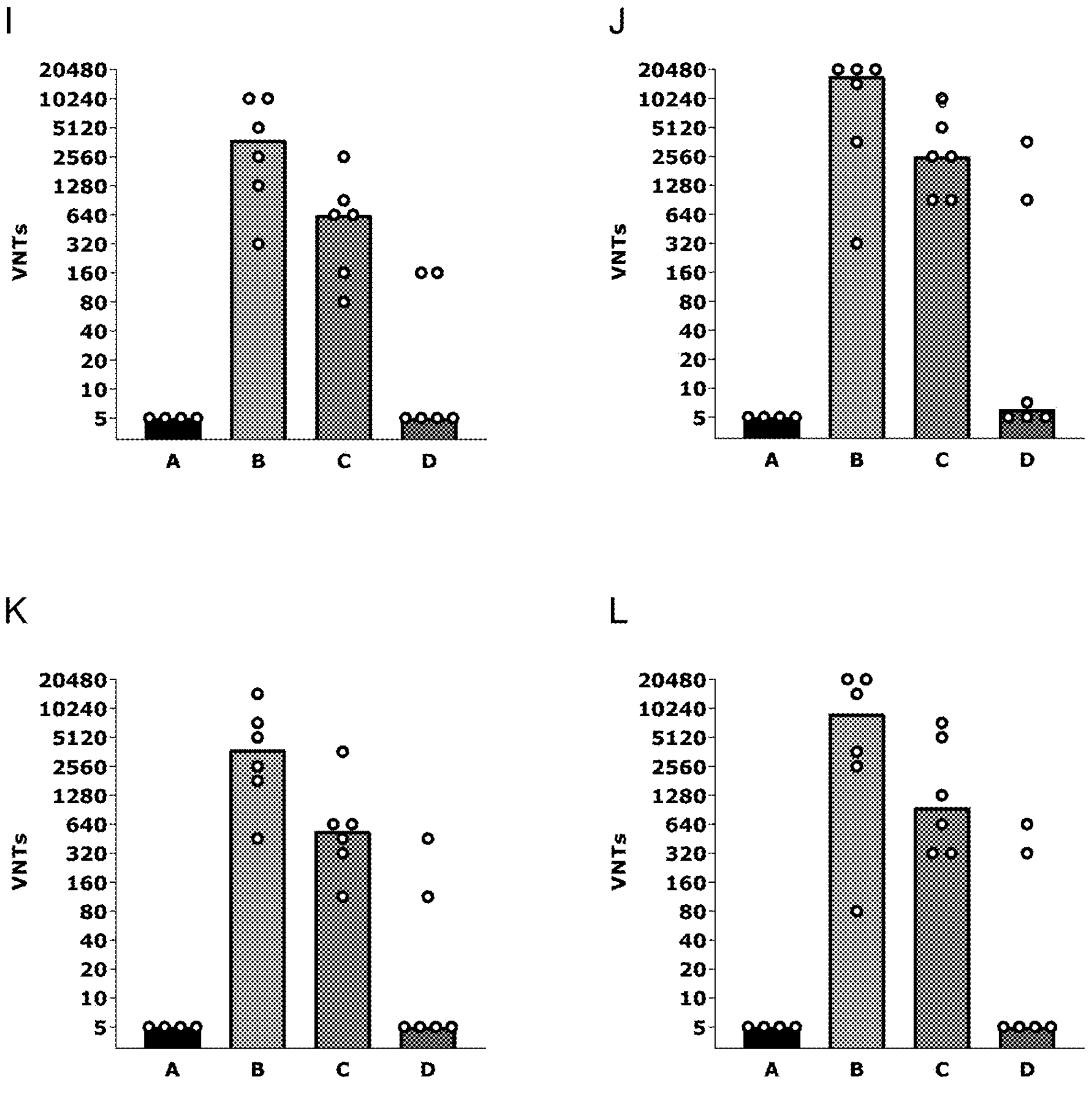

Results:

Overall, the bivalent vaccine composition CV2CoV+CV2CoV.351 induced comparable levels of spike-binding antibodies to ancestral and B.1.351 variant RBD on day 14 (FIG. 7A-7 D). Significant levels of spike-binding antibodies were detectable in all animals vaccinated with 2 µg or 8 µg of bivalent vaccine composition CV2CoV+CV2CoV.351 on day 14 post injection. Dose dependent levels of IgG1 and IgG2a spike-binding antibody titers were induced in all groups injected with 0.5 µg, 2 µg or 8 µg of bivalent vaccine composition CV2CoV+CV2CoV.351. The ratios between IgG1 and IgG2a antibodies showed a slightly lower induction of IgG2a antibodies compared to IgG1 for the 2 µg dose. FIGS. 7A and 7 B shows binding antibodies to ancestral SARS-CoV-2 RBD and FIGS. 7 C and 7 D to B.1.351 variant RBD. Robust VNTs were induced against ancestral SARS-CoV-2 in a dose dependent manner for the 2 and 8 µg groups over time (FIGS. 7E (day 14), 7F (day 21), and 7I (day 42)) and against B.1.351 variant SARS-CoV-2 (FIGS. 7G (day 14), 7H (day 21), and 7J (day 42)). FIGS. 7 K and 7 L shows the dose dependent induction of VNTs against variant B.1.1.7 and P.1 respectively, for the 2 µg and 8 µg dose groups.

Example 6: Booster Study: Vaccination of Rats with Bivalent CVnCoV and CVnCoV.351 Vaccine Upon i.m. Administration in Wistar Rats This study was designed to determine if a homologous boost is able to elicit significant increases of immune response against a heterologous variant (B.1.351).

Preparation of LNP Formulated mRNA Vaccine:

SARS-CoV-2 mRNA constructs (CV2CoV-LNP formulated mRNA based SARS-CoV-2 vaccine encoding for full length, pre-fusion stabilized ancestral SARS-CoV-2 S and CV2CoV.351-LNP formulated mRNA based SARS-CoV-2 vaccine encoding for full length, pre-fusion stabilized SARS-CoV-2 B.1.351 S) were prepared as described in Example 1.2 (RNA in vitro transcription). As indicated in Tables 4 and 11, in some constructs, uridine was replaced by 1-Methylpseudouridinie. HPLC purified mRNA was formulated with LNPs according to Example 1.4 prior to use in in vivo.

Immunization:

Rats were injected intramuscularly (i.m.) with mRNA vaccine compositions and doses as indicated in Table 11. As a negative control, one group of rats was vaccinated with buffer (group A). All animals were vaccinated in week 0 (day1) and week 3 (day 21) with the same vaccine composition. In week 15 the animal received a third vaccination partially with a different vaccine composition. Blood samples were collected on day 0, day 15, day 21, day 42, day 77, day 105, day 119, and day 133 for the determination of VNTs.

TABLE 11

| Vaccination regimen (Example 6) | | | | | | | |
|---|---|---|---|---|---|---|---|
| Group | Animals | 1st vaccination week 0 | 2nd vaccination week 3 | 3rd vaccination week 15 | Dose | Immunisation schedule | Serum isolation |
| A | N = 4 | NaCl | NaCl | NaCl | / | D 0, | D 0, |
| B | Wistar Female N = 6 | m1ψ ancestral S (R10162) | m1ψ ancestral S (R10162) | CV2CoV ancestral S | 8 μg | D 21, D 105 (3 M) | D 15 D 21 D 42 |
| C | | m1ψ ancestral S (R10162) | m1ψ ancestral S (R10162) | CV2CoV 351 Variant S | | | D 119 D 105 D 133 |
| D | | CV2CoV ancestral S | CV2CoV ancestral S | CV2CoV ancestral S | | | |
| E | | CV2CoV ancestral S | CV2CoV ancestral S | CV2CoV.351 Variant S | | | |
| F | | CVnCoV ancestral S | CVnCoV ancestral S | CV2CoV ancestral S | | | |
| G | | CVnCoV ancestral S | CVnCoV ancestral S | CV2CoV.351 Variant S | | | |

CV2CoV is shown as R9709 in Table 4 and CV2CoV.351 is shown as R10384 Table 4

Determination of VNTs were performed as described in Example 2.

Figure 8:
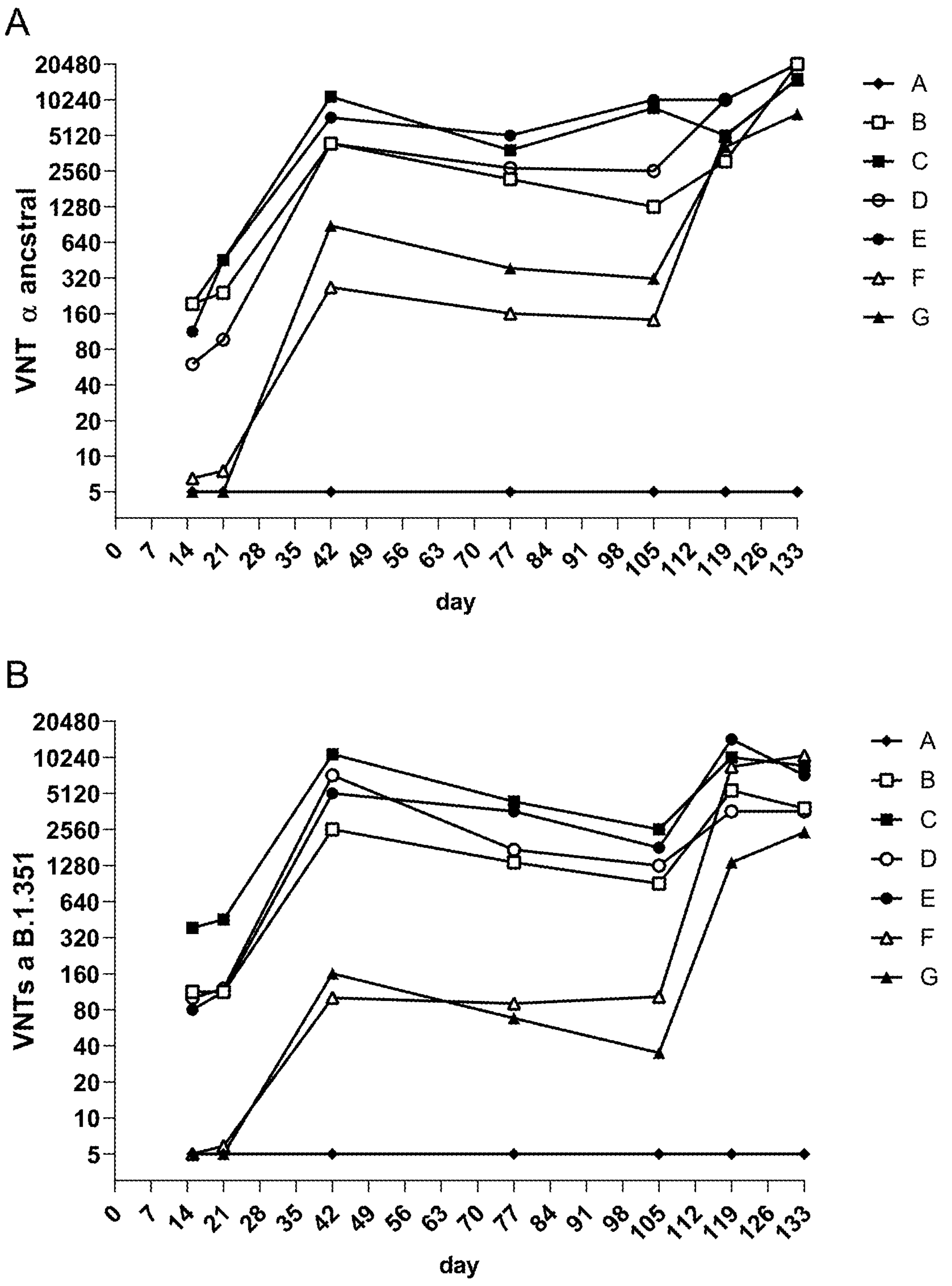
FIG. 8 shows of VNTs assessed in a CPE-based assay using ancestral SARS-CoV-2 (FIG. 8A) or using B.1.351 variant SARS-CoV-2 (FIG. 8 B). Boost with CV2CoV or B.1.351 variant vaccine CV2CoV.351 shows strong boost capacity against ancestral SARS-CoV-2 and B.1.351 variant SARS-CoV-2 for homologous and heterologous response. Homologous response is shown in FIG. 8A for group B, D and F and in FIG. 8 B for group C, E and G. Heterologous response is shown in FIG. 8A for group C, E and G and in FIG. 8 B for group B, D and F. Virus-neutralizing responses against ancestral SARS-CoV-2 as well as against SARS-CoV-2 B.1.1.7 (alpha), B.1.351 (beta) and P.1 (gamma) variants were tested 14 days after boosting (FIG. 8 C-8 F) on day 119 (VNTs against ancestral SARS-CoV-2 (FIG. 8 C), against SARS-CoV-2 B.1.351 (FIG. 8 D), SARS-CoV-2 B.1.1.7 (FIG. 8 E) and against P.1 (FIG. 8 F).
Figure 8:
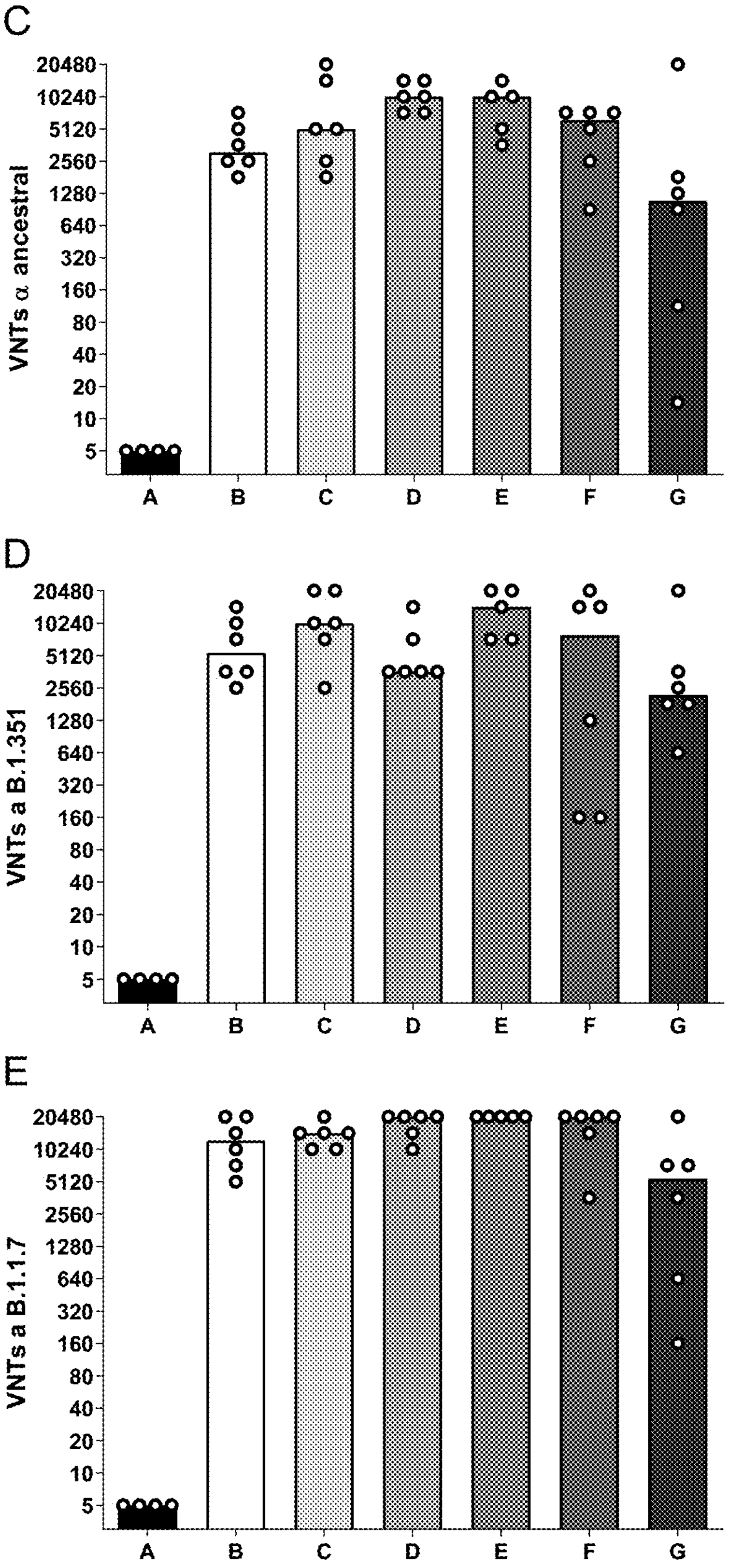
Figure 8:
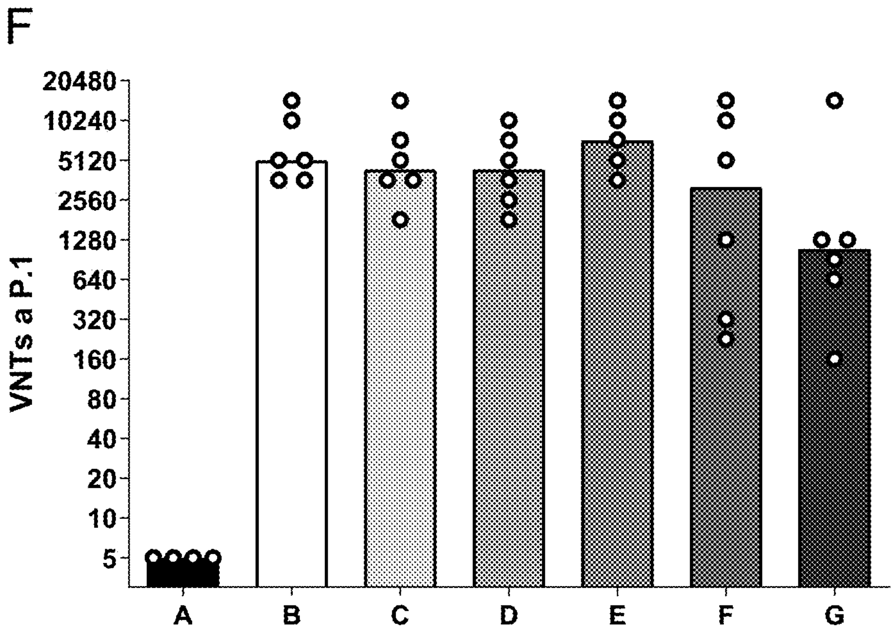

Results:

Overall, boosting with either CV2CoV or CV2CoV.351 three months post two prime vaccinations with CVnCoV, CV2CoV or "m1ψ ancestral S" (R10162) induced a significant increase of virus neutralizing antibodies against both ancestral and B.1.351 SARS-CoV-2 (FIGS. 8A and 8 B, respectively). Boosting with both CV2CoV and CV2CoV.351 induced VNTs that were able to neutralize ancestral SARS-CoV-2 and SARS-CoV-2 B.1.351, B.1.1.7 and P.1 variants (FIG. 8 C-8 F).

VNTs Against Ancestral SARS-CoV-2 (FIG. 8A):

CVnCoV induced robust VNTs against ancestral SARS-CoV-2 upon two vaccinations in rats (groups G and F). Titers remained readily detectable until boosting on d105 with a small decrease of titers measured over time. CV2CoV (homologous vaccine) showed high boosting capacity on the background of CVnCoV prime vaccination (group F): VNTs against ancestral SARS-CoV-2 were significantly increased by a factor of 109 (d105 vs d119) upon CV2CoV boosting.

Compared to responses upon boosting with CV2CoV, titers induced by boosting with CV2CoV.351 (heterologous vaccine) against ancestral SARS-CoV-2 were lower (group G). The observed difference between titers detected on d105 and d119 amounted to an increase of 6 fold. However, the difference was not statistically significant. Similar results can be achieved with prime vaccinations with CV2CoV or "m1ψ ancestral S" (R10162), whereby the titers before the third ("boosting) vaccination on day 105 are significantly increased compared to CVnCoV induced VNTs.

VNTs against SARS-CoV-2 B.1.351 (FIG. 8 B):

CVnCoV induced robust VNTs against SARS-CoV-2 B.1.351 upon two vaccinations in rats. However, titers were overall lower than against ancestral SARS-CoV-2 (comparing FIG. 8 B with FIG. 8A). Boosting with CV2CoV.351 (homologous vaccine) induced a significant increase of 109 fold compared to VNTs detected on d105 vs d119 (group G).

CV2CoV (heterologous vaccine) showed a high boosting capacity on the background of CVnCoV prime vaccination (group F): VNTs against SARS-CoV-2 B.1.351 were significantly increased by a factor of 256 (d105 vs d119) upon CV2CoV boosting.

Similar results can be achieved with prime vaccinations with CV2CoV or "m1ψ ancestral S" (R10162), whereby the titers before the third ("boosting) vaccination are significantly increased compared to CVnCoV induced VNTs.

Virus-neutralizing responses against ancestral SARS-CoV-2 as well as against SARS-CoV-2 B.1.1.7 (alpha), B.1.351 (beta) and P.1 (gamma) variants were tested 14 days after boosting (FIG. 8 C-8 F).

Boosting with CV2CoV.351 (homologous vaccine, groups C, E, and G) induced not only strong VNTs against SARS-CoV-2 B.1.351 on d119 (FIG. 8 D), but also against the ancestral SARS-CoV-2 (FIG. 8 C), SARS-CoV-2 B.1.1.7 (FIGS. 8 E) and P.1 (FIG. 8 F) (heterologous vaccine).

Example 7: Vaccination of Mice with mRNA Vaccines Encoding SARS-CoV-2 Variants This study was designed to determine if vaccinations with mRNA vaccines encoding SARS-CoV-2 variants induce immunogenicity with cross-neutralizing capacity.

Preparation of LNP Formulated mRNA Vaccine:

SARS-CoV-2 mRNA constructs CV2CoV-mRNA based SARS-CoV-2 vaccine encoding for full length, pre-fusion stabilized ancestral or variant SARS-CoV-2 were prepared as described in Example 1.2 (RNA in vitro transcription). HPLC purified mRNA was formulated with LNPs according to Example 1.4 prior to use in in viva Immunization:

Mice were injected intramuscularly (i.m.) with mRNA vaccine compositions and doses as indicated in Table 12. As a negative control, one group of mice was vaccinated with buffer (group 1). All animals were vaccinated on day 0 and day 21. Blood samples were collected on day 0, day 14, day 21, and day 42 for the determination of antibody titers.

TABLE 12

| Vaccination regimen (Example 7) | | | | | | |
|---|---|---|---|---|---|---|
| Group | Animals | mRNA | Dose | Immunisation schedule | Serum isolation |
| 1 | N = 8 | Neg. control: NaCl | / | D 0, | D 0 |
| 2 | Balb/c | R9709 CV2CoV (ancestral) | 1 μg | D 21 | D 14 |
| 3 | female | R10357 B1.1.7 (alpha) | | | D 21 |
| 4 | | R10384 B1.351 (beta) CV2CoV.351 | | | D 42 |
| 5 | | R10410 B.1.1.7 + E484K | | | |
| 6 | | R10385 P.1 (gamma) | | | |
| 7 | | R10452 B.1.351 (beta) | | | |

Determination of IgG1 Antibody Titers Using ELISA:

ELISA was performed using recombinant SARS-CoV-2 S protein (ancestral SARS-CoV-2 RBD or B.1.351 RBD variant (K427N, E484K, N501Y)) for coating. Coated plates were incubated using respective serum dilutions, and binding of specific antibodies to SARS-CoV-2 RBD or RBD variant were detected using biotinylated isotype specific anti-mouse antibodies followed by streptavidin-HRP (horse radish peroxidase) with Amplex as substrate. Endpoint titers of antibodies were measured by ELISA on day 14 post prime vaccination.

Determination of VNTs:

Determination of VNTs assessed in a CPE-based assay was performed as described in Example 2. For detection of VNTs against the SARS-CoV-2 delta variant, the virus strain hCoV-19/France/IDF-APHP-HEGP-20-23-2131905084/2021|EPI_ISL_2029113|2021-04-27 was used comprising the following mutations: T19R E156G d157F d158R L452R T478K D614G P681R D950N.

Intracellular Cytokine Staining:

Splenocytes from vaccinated mice were isolated on day 42 according to a standard protocol known in the art. Briefly, isolated spleens were grinded through a cell strainer and washed in PBS/1% FBS followed by red blood cell lysis. After an extensive washing step with PBS/1% FBS, splenocytes were seeded into 96-well plates (2×106 cells per well). Cells were stimulated with a mixture of SARS-CoV-2 ancestral S protein specific peptides (1 μg/ml) in the presence of 2.5 μg/ml of an anti-CD28 antibody (BD Biosciences) for 6 hours at 37° C. in the presence of a protein transport inhibitor. The same procedure was repeated for stimulating the splenocytes with a mixture of SARS-CoV-2 B.1.351 S protein specific peptides. After stimulation, cells were washed and stained for intracellular cytokines using the Cytofix/Cytoperm reagent (BD Biosciences) according to the manufacturer's instructions. The following antibodies were used for staining: Thy1.2-FITC (1:200), CD8-APC-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye was used to distinguish live/dead cells (Invitrogen). Cells were acquired using a ZE5 flow cytometer (Bio-Rad). Flow cytometry data was analyzed using FlowJo software package (Tree Star, Inc.).

Figure 9:
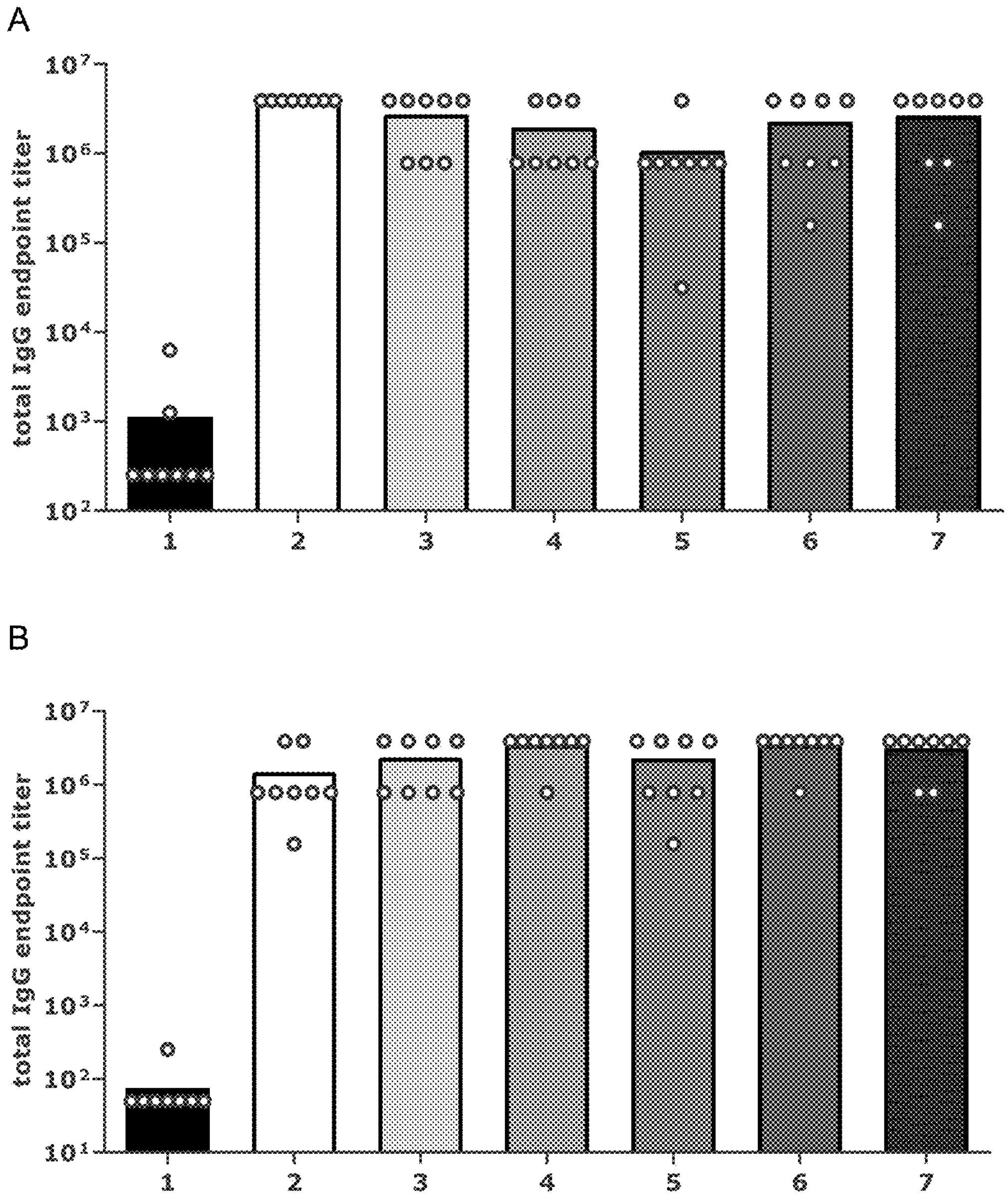
FIG. 9 shows significant total IgG spike-binding antibody responses to the ancestral SARS-CoV-2 RBD (FIG. 9 A) and the B.1.351 RBD variant K417N, E484K, N501Y (FIG. 9 B) on day 14 for all groups. Induction of VNTs against different SARS-CoV-2 variants over time is shown in FIGS. 9 C-F (FIG. 9 C: ancestral.
Figure 9:
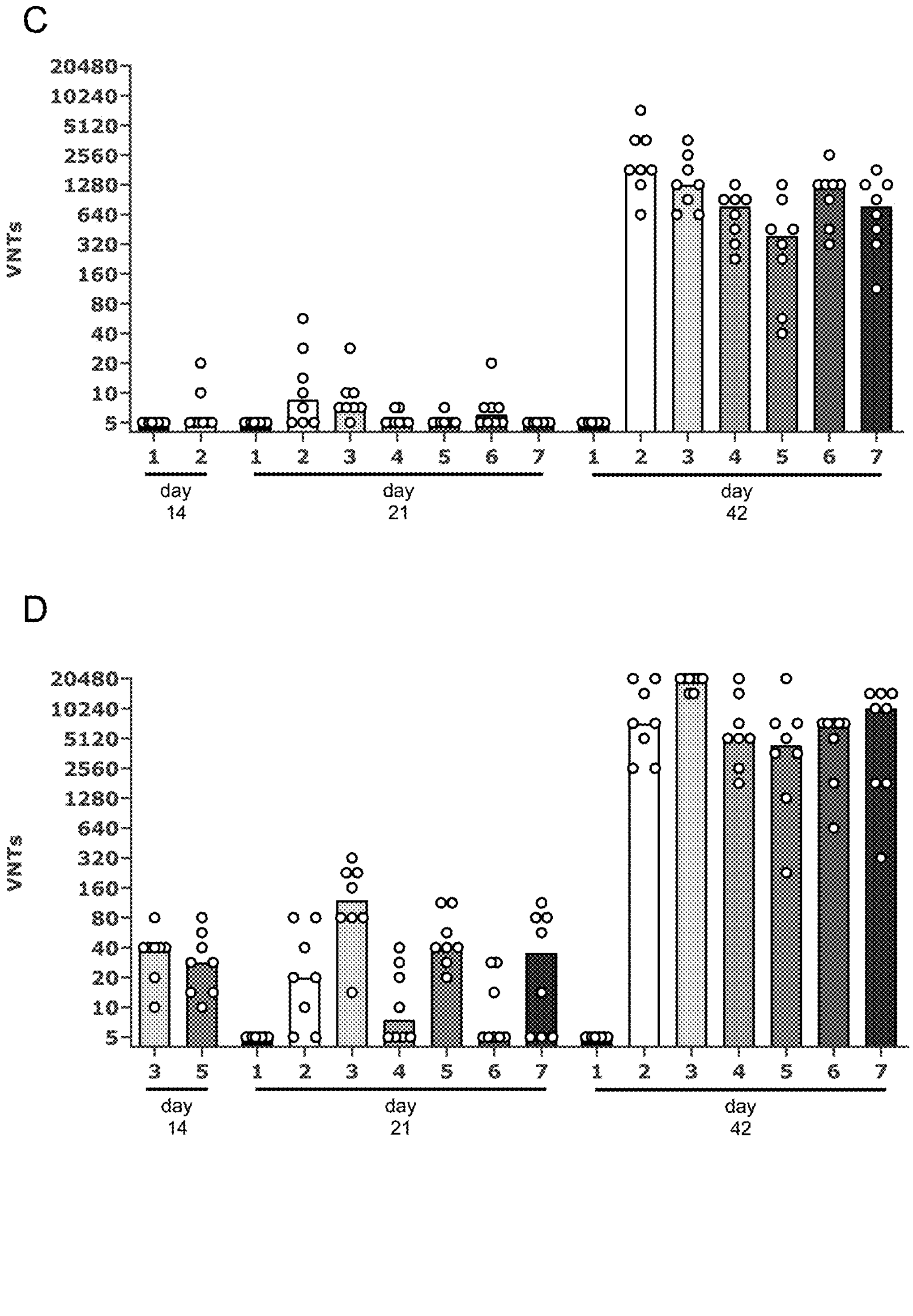
Figure 9:
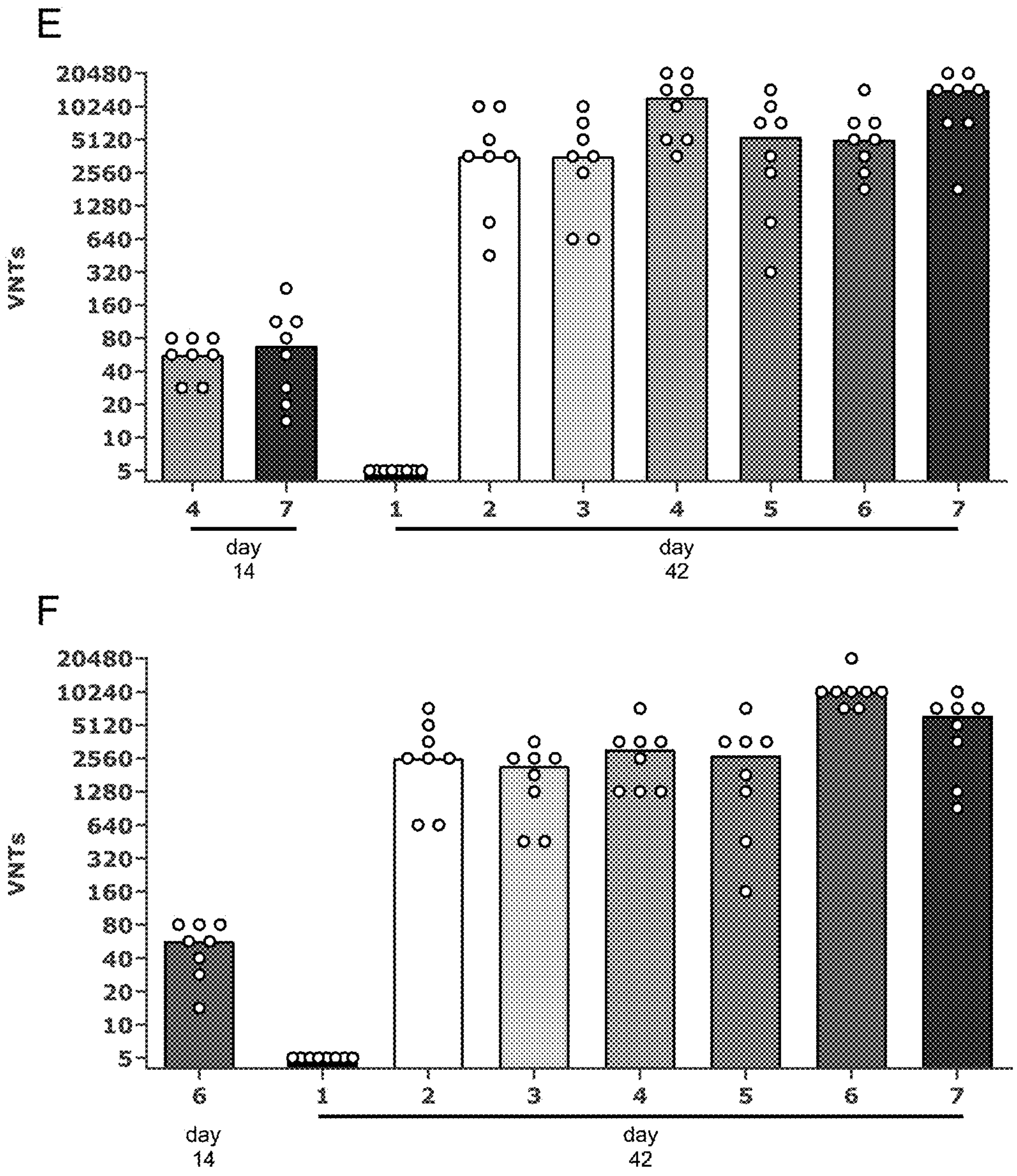
Figure 9:
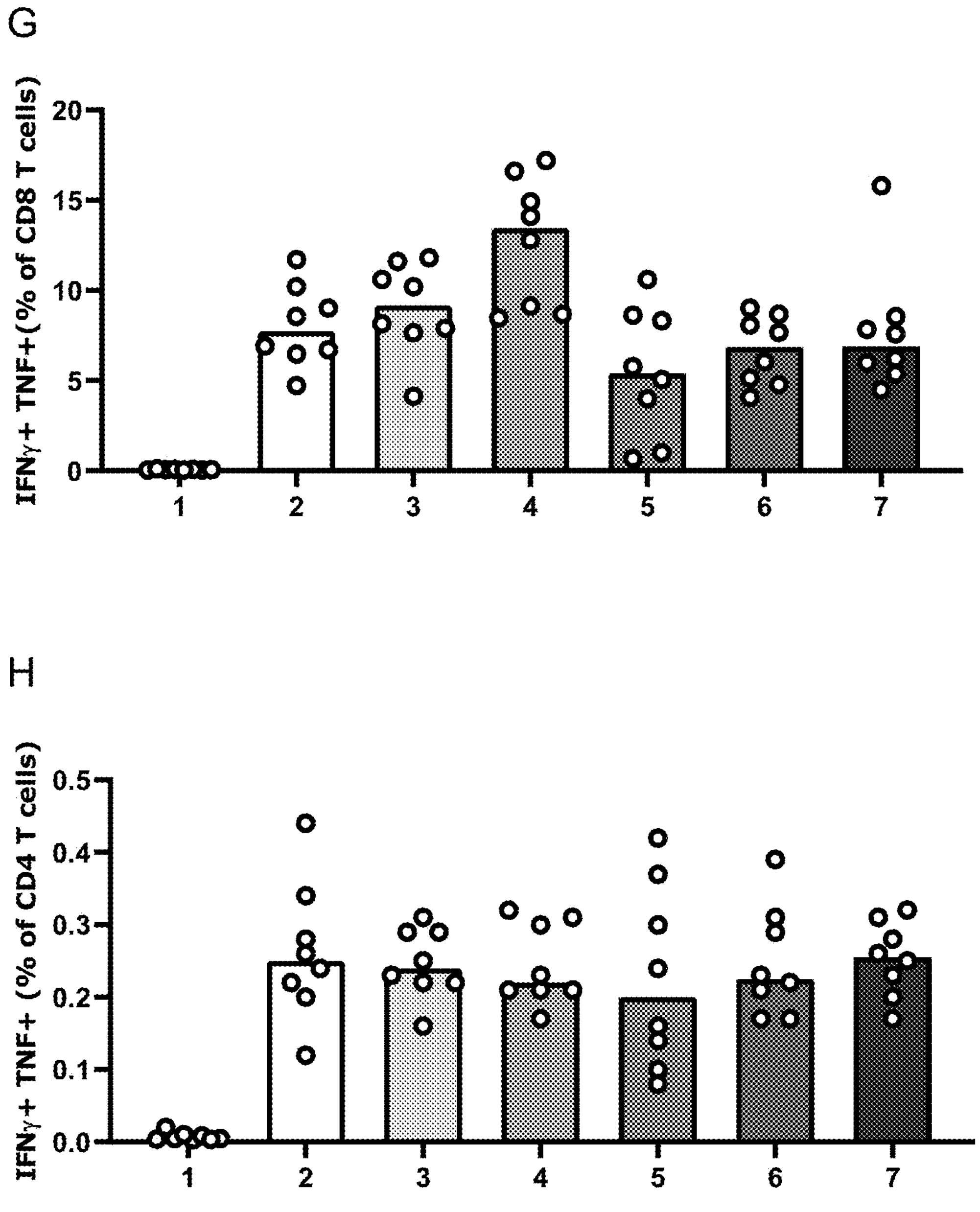
Figure 9:
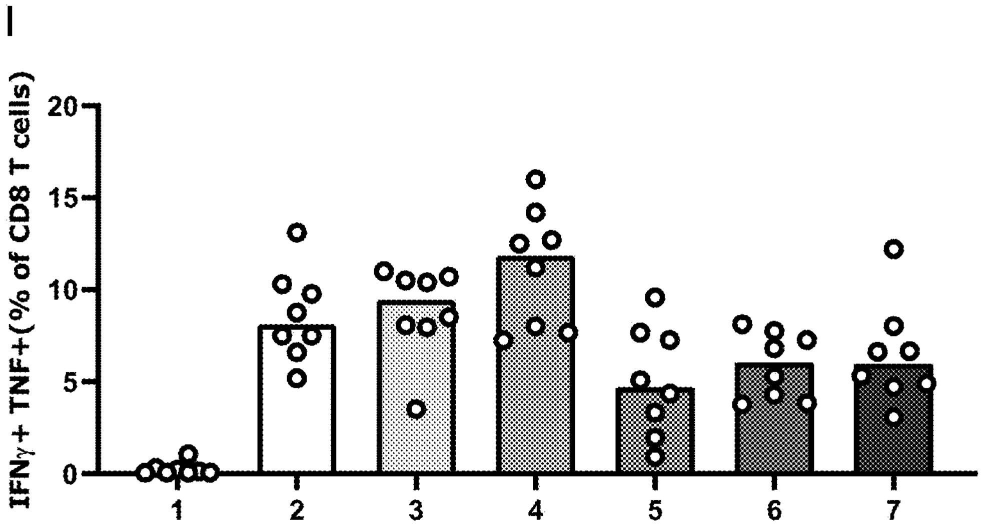
Figure 9:
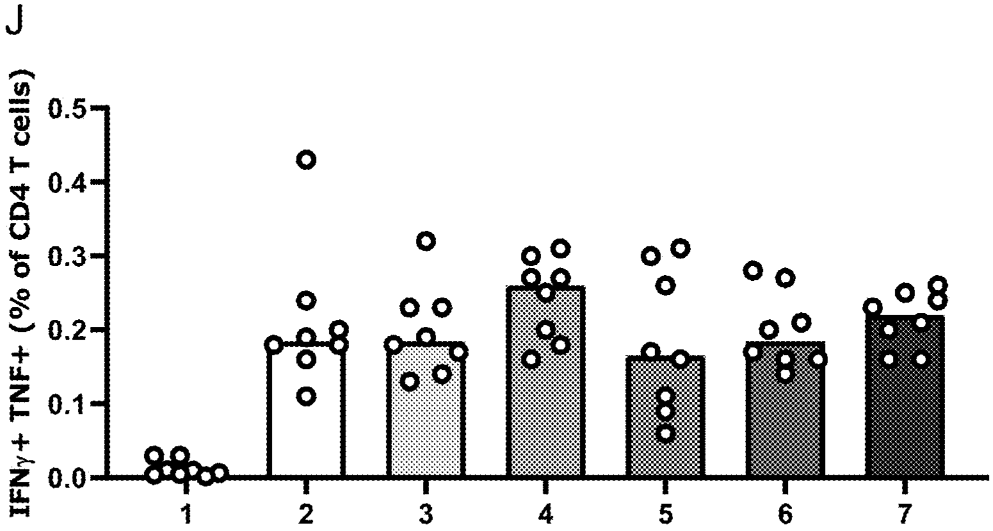

Results:

On day 14, all tested SARS-CoV-2 mRNA vaccine constructs encoding for full length, pre-fusion stabilized ancestral or variant SARS-CoV-2 induced high IgG antibody responses to ancestral SARS-CoV-2 RBD (FIG. 9A) and the B.1.351 variant RBD (K417N, E484K, N501Y) FIG. 9 B.

All of the tested mRNA vaccine constructs showed a strong induction of VNTs on day 42, which is most prominent and also detectable on earlier time points (d14, d21) for homologous neutralization (FIG. 9 C: group 2, ancestral; FIG. 9 D: group 3, B.1.1.7; FIG. 9 E: group 4 and 7, B.1.351; FIG. F: group 6, P1).

As shown in FIG. 9 G-J the vaccination with mRNA encoding the different variant full length S stabilized proteins induced robust levels of antigen-specific $CD4^+$ and $CD8^+$ IFN□/TNF double positive T cells after two vaccinations on day 42 to a similar extent upon stimulation of splenocytes with ancestral (FIGS. G and H) or B.1.351 (FIGS. I and J) peptide libraries.

Example 8: Vaccination of Mice with mRNA Vaccines Encoding SARS-CoV-2 Variants This study was designed to determine if vaccination with mRNA vaccines encoding SARS-CoV-2 variants induces immunogenicity with cross-neutralizing capacity.

Preparation of LNP Formulated mRNA Vaccine:

SARS-CoV-2 mRNA constructs (CV2CoV-LNP formulated mRNA based SARS-CoV-2 vaccine encoding for full length, pre-fusion stabilized ancestral or variant SARS-CoV-2 S (S_stab) were prepared as described in Example 1.2 (RNA in vitro transcription). HPLC purified mRNA was formulated with LNPs according to Example 1.4 prior to use in in vivo.

Immunization:

Mice were injected intramuscularly (i.m.) with mRNA vaccine compositions and doses as indicated in Table 13. As a negative control, one group of mice was vaccinated with buffer (group 13). All animals were vaccinated on day 0 and day 21. Blood samples were collected on day 0, day 14, day 21, and day 42 for the determination of antibody titers.

TABLE 13

| Vaccination regimen (Example 8) | | | | | |
|---|---|---|---|---|---|
| Group | Animals | mRNA | Dose | Immunisation schedule | Serum isolation |
| 1 | N = 8 | R9709 | 1 μg | D 0, | D 0 |
| 2 | Balb/c | R10384 B.1.351 (Beta, South Africa) | | D 21 | D 14 |

TABLE 13-continued

| Vaccination regimen (Example 8) | | | | | |
|---|---|---|---|---|---|
| Group | Animals | mRNA | Dose | Immunisation schedule | Serum isolation |
| 3 | female | R10631 E484K, D614G | | | D 21 |
| 4 | | R10614 B.1.429 (Epsilon, USA) | | | D 42 |
| 5 | | R10520 B.1.525 (Eta, multiple) | | | |
| 6 | | R10577 B.1.525_v2 (Eta, multiple) | | | |
| 7 | | R10575 B.1.258 (Czech Republic) | | | |
| 8 | | R10579 B.1.526_v1 (Iota, USA) | | | |
| 9 | | R10581 B.1.526_v2 (Iota, USA) | | | |
| 10 | | R10592A.23.1_v1 (Rwanda/Uganda) | | | |
| 11 | | R10616P.1_v2 (Gamma, Brazil) | | | |
| 12 | | R10360 B.1.617_v2 8 (Delta, India) | | | |
| 13 | | Neg. control: NaCl | — | | |

Determination of VNTs with homologous and heterologous variants can be performed as described in Example 2. For T-cell analysis splenocytes were isolated on day 42.

T-Cell Analysis by Intracellular Cytokine Staining (ICS):

Splenocytes from vaccinated mice were isolated according to a standard protocol known in the art. Briefly, isolated spleens were grinded through a cell strainer and washed in PBS/1% FBS followed by red blood cell lysis. After an extensive washing step with PBS/1% FBS, splenocytes were seeded into 96-well plates ($2\times10^6$ cells per well). Cells were stimulated with a mixture of SARS-CoV-2 ancestral S protein specific peptides (1 μg/ml) in the presence of 2.5 μg/ml of an anti-CD28 antibody (BD Biosciences) for 6 hours at 37° C. in the presence of a protein transport inhibitor. After stimulation, cells were washed and stained for intracellular cytokines using the Cytofix/Cytoperm reagent (BD Biosciences) according to the manufacturer's instructions. The following antibodies were used for staining: Thy1.2-FITC (1:200), CD8-APC-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye was used to distinguish live/dead cells (Invitrogen). Cells were acquired using a ZE5 flow cytometer (Bio-Rad). Flow cytometry data was analyzed using FlowJo software package (Tree Star, Inc.).

Figure 10:
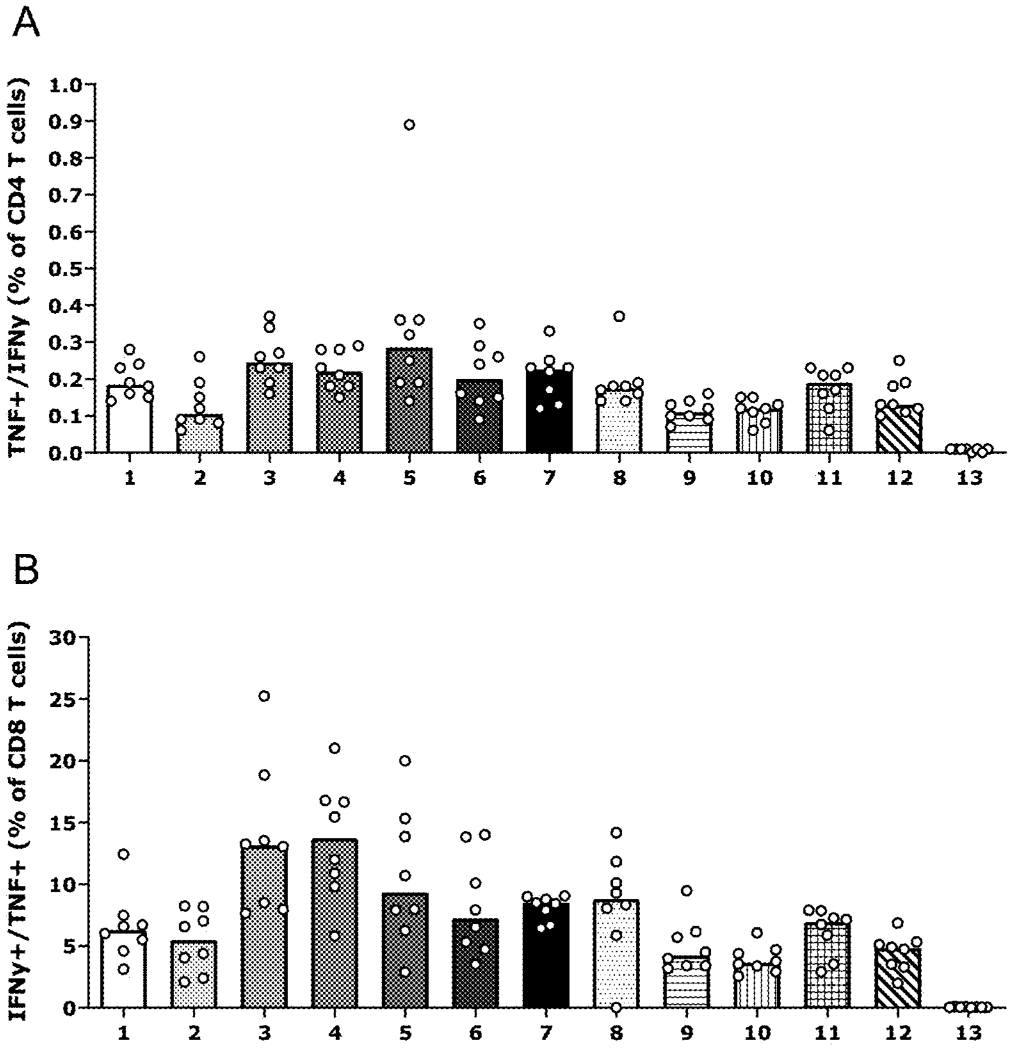
FIG. 10 shows cellular immune responses of CD8 (FIG. 10 B) and CD4 (FIG. 10A) positive T-cells in mice stimulated with a mixture of ancestral SARS-CoV-2 peptide library, using an intracellular cytokine staining assay.

Results:

As shown in FIG. 10 the vaccination with mRNA encoding the different variant full length S stabilized proteins induced robust levels of antigen-specific $CD4^+$ and $CD8^+$ IFNγ/TNF double positive T cells (FIGS. 10A and B respectively) after two vaccinations on day 42 upon stimulation of splenocytes with ancestral peptide library. It seems likely that the humoral responses (ELISA or VNTs) would behave in a similar way as shown in Example 7 (not yet tested for the vaccine constructs of Table 13).

Example 9A: Vaccination of Mice with mRNA Vaccines Encoding SARS-CoV-2 Variants (Prophetic)

Within this study, it can be determined if vaccination with mRNA vaccines encoding SARS-CoV-2 variants induces immunogenicity with cross-neutralizing capacity.

Preparation of LNP Formulated mRNA Vaccine:

SARS-CoV-2 mRNA constructs (CV2CoV-mRNA based SARS-CoV-2 vaccine encoding for full length, pre-fusion stabilized ancestral or variant SARS-CoV-2 S (S_stab) are prepared as described in Example 1.2 (RNA in vitro transcription). HPLC purified mRNA is formulated with LNPs according to Example 1.4 prior to use in in vivo.

Immunization:

Mice are injected intramuscularly (i.m.) with mRNA vaccine compositions and doses as indicated in Table 14A. As a negative control, one group of mice is vaccinated with buffer (group 1). All animals are vaccinated on day 0 and day 21. Blood samples are collected on day 0, day 14, day 21, and day 42 for the determination of antibody titers.

TABLE 14A

| Vaccination regimen | | | | | |
|---|---|---|---|---|---|
| Group | Animals | mRNA | Dose | Immunisation schedule | Serum isolation |
| 1 | N = 8 | Neg. control: 0.9% NaCl | — | | |
| 2 | Balb/c | R9709 (ancestral) | 1 μg | D 0 | D 0 |
| 3 | female | R10800 C37.1 (Lambda, Peru) | | D 21 | D 14 |
| 4 | | R10679 B.1.621 (Mu, Colombia) | | | D 21 |
| 5 | | R10630 B.1.617.2 (Delta) | | | D 42 |
| 6 | | R10884 B.1.617.2.v2 (Delta) | | | |
| 7 | | R10801 AY.1 | | | |
| 8 | | R10802 AY.2 | | | |
| 9 | | R11036 AY.4.2 | | | |

Determination VNTs with homologous and heterologous variants are performed as described in Example 2 and Example 7. For T-cell analysis splenocytes are isolated on day 42. T-cell analysis by Intracellular cytokine staining (ICS) is performed as described in Example 8. Further constructs encoding new upcoming variants can be tested in a similar way.

Example 9B: Vaccination of Rats with mRNA Vaccines Encoding SARS-CoV-2 Variants (Prophetic)

Within this study, it can be determined if vaccination with mRNA vaccines encoding SARS-CoV-2 variants induces immunogenicity with cross-neutralizing capacity.

Preparation of LNP Formulated mRNA Vaccine:

SARS-CoV-2 mRNA constructs (CV2CoV-mRNA based SARS-CoV-2 vaccine encoding for full length, pre-fusion stabilized omicron variant SARS-CoV-2 S (S_stab) are prepared as described in Example 1.2 (RNA in vitro transcription). HPLC purified mRNA is formulated with LNPs according to Example 1.4 prior to use in in vivo.

Immunization:

Wistar rats are injected intramuscularly (i.m.) with mRNA vaccine compositions and doses as indicated in Table 14B. As a negative control, one group of rats is vaccinated with buffer (group 1). All animals are vaccinated on day 0 and day 21. Blood samples are collected on day 0, day 14, day 21, and day 42 for the determination of antibody titers.

TABLE 14B

| Vaccination regimen | | | | | |
|---|---|---|---|---|---|
| Group | Animals | mRNA | mRNA Dose | Immunisation schedule | Serum isolation |
| 1 | Wistar Female N = 6 | Neg. control: 0.9% NaCl | — | D 0<br>D 21 | D 0<br>D 14<br>D 21<br>D 42 |
| 2 | Wistar | CV2CoV.529 (omicron variant S) nat Nt | 2 μg | | |
| 3 | Female | CV2CoV.529 (omicron variant S) nat Nt | 8 μg | | |
| 4 | N = 8 | CV2CoV.529 (omicron variant S) nat Nt | 20 μg | | |
| 5 | | CV2CoV.529 (omicron variant S) ψ | 2 μg | | |
| 6 | | CV2CoV.529 (omicron variant S) ψ | 8 μg | | |
| 7 | | CV2CoV.529 (omicron variant S) ψ | 20 μg | | |
| 8 | | CV2CoV.529 (omicron variant S) m1ψ | 2 μg | | |
| 9 | | CV2CoV.529 (omicron variant S) m1ψ | 8 μg | | |
| 10 | | CV2CoV.529 (omicron variant S) m1ψ | 20 μg | | |

CV2CoV.529 is shown e.g.as R11175, R11176, R11177, R11178 in Table 4.

Determination VNTs with homologous and heterologous SARS-CoV-2 variants are performed as described in Example 2. For T-cell analysis splenocytes are isolated on day 42. T-cell analysis by Intracellular cytokine staining (ICS) is performed as described in Example 8. Further constructs encoding new upcoming variants can be tested in a similar way.

Example 10: Extended Multivalency Vaccination Study: Immunogenicity of a Bivalent CV2CoV and CV2CoV.351 Vaccine Upon i.m. Administration in Wistar Rats The objective of this study is to assess boost response after CVnCoV vaccination upon a third vaccination with multivalent CV2CoV/CV2CoV.351.

Preparation of LNP Formulated mRNA Vaccine:

SARS-CoV-2 mRNA constructs (CV2CoV-mRNA based SARS-CoV-2 vaccine encoding for full length, pre-fusion stabilized ancestral SARS-CoV-2 S and CV2CoV.351-mRNA based SARS-CoV-2 vaccine encoding for full length, pre-fusion stabilized SARS-CoV-2 B.1.351 S) were prepared as described in Example 1.2 (RNA in vitro transcription). HPLC purified mRNA was formulated with LNPs according to Example 1.4 and Example 1.5 (separately mixed or formulated for bivalent mRNA vaccines) prior to use in in vivo vaccination experiments.

Immunization:

Rats were injected intramuscularly (i.m.) with mRNA vaccine compositions and doses as indicated in Table 14. Buffer vaccinated animals served as a negative control (group C). All animals were vaccinated on week 0, week 3 (day 21) and on week 15 (day 105). Blood samples were collected on day 0, day 14, day 21, day 42, day 77, day 105, day 119 and day 133 for the determination of antibody titers.

TABLE 15

| Vaccination regimen (Example 10) | | | | | |
|---|---|---|---|---|---|
| Group | Animals | 1st vaccination week 0 | 2nd vaccination week 3 | 3rd vaccination week 15 | Serum isolation |
| A | N = 4 | NaCl | NaCl | NaCl | D 0 (18 h), |
| B | Wistar Female N = 6 | CVnCoV 16 μg | CVnCoV 16 μg | CV2CoV + CV2CoV.351 8 μg (mixed 2 LNPs) | Week 2 (D 14)<br>Week 3 (D 21)<br>Week 6 (D 42) |
| C | | CV2CoV 8 μg | CV2CoV 8 μg | CV2CoV + CV2CoV.351 8 μg (mixed 2 LNPs) | Week 11 (D 77)<br>Week 15 (D 105)<br>Week 17 (D 119)<br>Week 19 (D 133) |

CVnCoV is shown as R9515, CV2CoV as R9709 and CV2CoV.351 as R10384 in Table 4.

Determination of VNTs were performed as described in Example 2.

Results:

As shown in FIG. 11A CVnCoV and CV2CoV induced robust VNTs against ancestral SARS-CoV-2 upon two vaccinations in rats. Titers remained readily detectable until boosting on day 105 with a small decrease of titers measured over time for CVnCoV.

Bivalent CV2CoV+CV2CoV.351 vaccine composition showed high boosting capacity on the background of CVnCoV prime vaccination: VNTs against ancestral SARS-CoV-2 were significantly increased by a factor of 30 (d105 vs d119) and a factor of 45 (d105 vs d133) upon CV2CoV+CV2CoV.351 boosting (group B). On the background of CV2CoV prime vaccination the bivalent CV2CoV+CV2CoV.351 vaccine composition showed further boosting capacity of already high VNTs on day 105.

Figure 11:
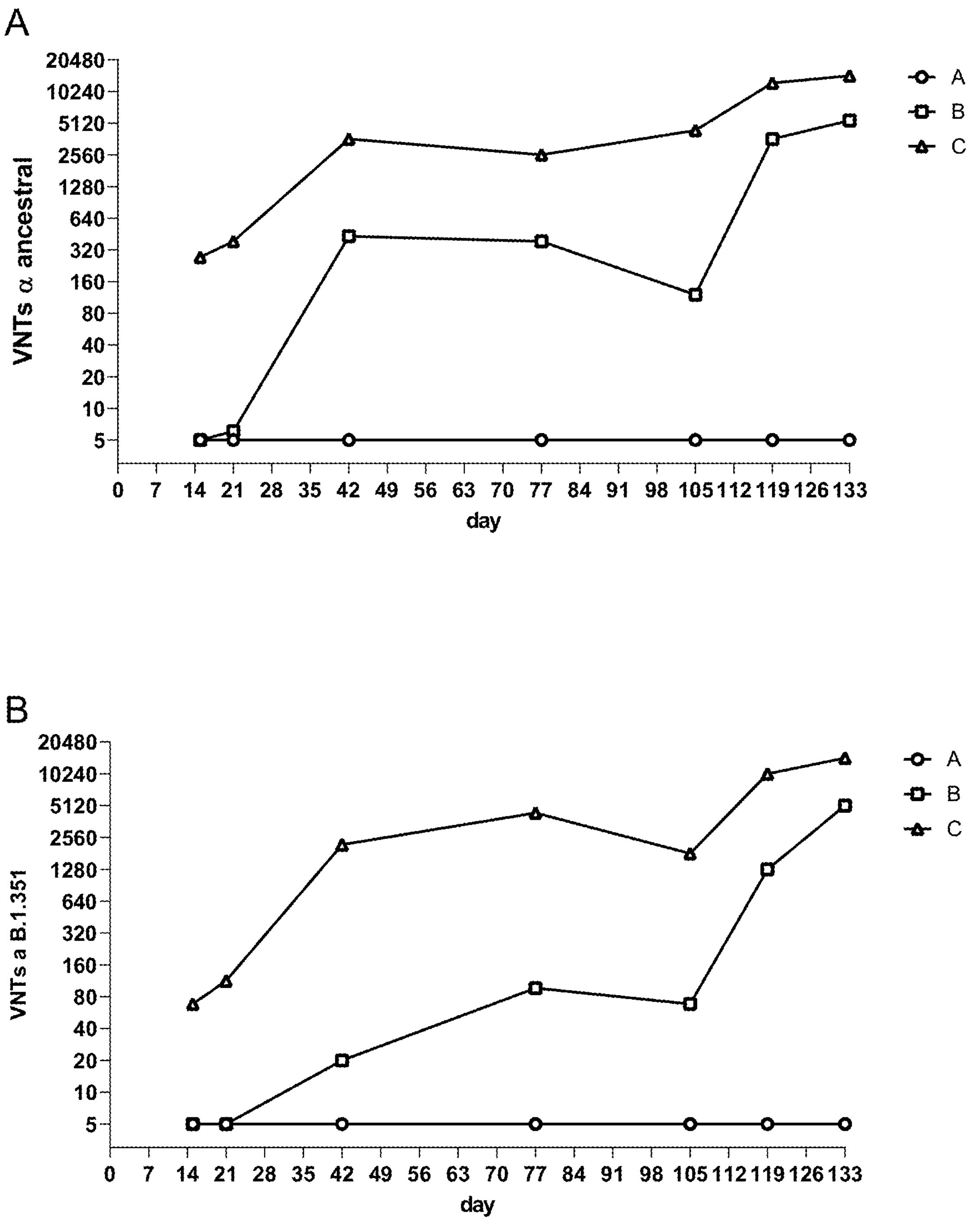
FIG. 11 shows VNTs upon prime and boost vaccination with CVnCoV or CV2CoV and a third Vaccination with bivalent CV2CoV+CV2CoV.351 vaccine composition in rats over time up to day 133 after first vaccination (FIG. 11A: VNTs against ancestral SARS-CoV-2, FIG. 11 B: VNTs against SARS-CoV-2 B.1.351). Robust and high VNTs on day 119 were induced not only against ancestral and B.1.351 SARS-CoV-2, but also against B.1.1.7 and P.1 SARS-CoV-2 variants (FIG. 11 C: ancestral, FIG. 11 D: B.1.351, FIG. 11 E: B.1.1.7, FIG. 11 F: P.1).
Figure 11:
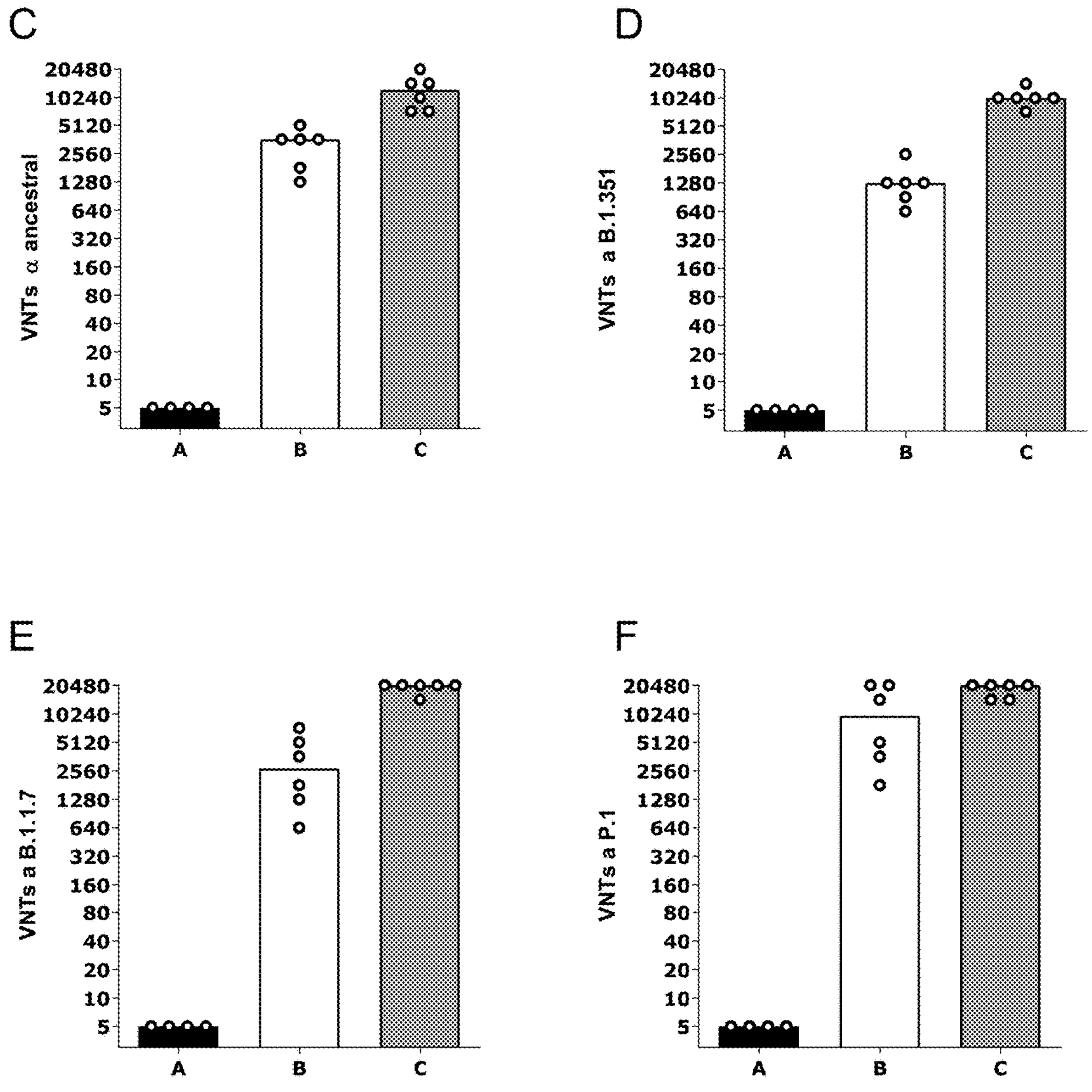

As shown in FIG. 11 B CVnCoV induced robust VNTs against SARS-CoV-2 B.1.351 upon two vaccinations in rats. Titers directed against B.1.351 were overall lower than titers against ancestral virus. Titers remained readily detectable until boosting on day 105 with a small decrease of VNTs measured over time for CVnCoV and CV2CoV vaccinated animals. Bivalent CV2CoV+CV2CoV.351 vaccine composition showed high boosting capacity on the background of CVnCoV prime vaccination: VNTs against SARS-CoV-2 B.1.351 were significantly increased by a factor of 19 (d105 vs d119) and a factor of 75 (d105 vs d133) upon CV2CoV+CV2CoV.351 boosting. On the background of CV2CoV prime vaccination the bivalent CV2CoV+CV2CoV.351 vaccine composition showed further boosting capacity of already high VNTs against SARS-CoV-2 B.1.351 on day 105.

While neutralizing titers detected against B.1.351 remained lower than titers induced against ancestral SARS-CoV-2 until day 105 of the experiment, VNTs against both viruses measured upon boosting with CV2CoV+CV2CoV.351 vaccine composition reached comparable levels by day 133 (FIG. 11A versus FIG. 11 B).

As shown in FIGS. 11 C-11 F robust and high VNTs were induced on day 119 in both groups B and C not only against ancestral and B.1.351 SARS-CoV-2, but also against B.1.1.7 and P.1 SARS-CoV-2 variants (FIG. 11 C: ancestral, FIG. 11 D: B.1.351, FIG. 11 E: B.1.1.7, FIG. 11 F: P.1).

To conclude, boosting with bivalent CV2CoV+CV2CoV.351 vaccine composition three months post two prime vaccinations with CVnCoV or CV2CoV induced a significant increase of VNTs against ancestral SARS-CoV-2 as well as SARS-CoV-2 B.1.351, and elicited high levels of VNTs against B.1.1.7 and P.1 variants.

Example 11: Vaccination of Rats with mRNA Encoding SARS-CoV-2 Variant B1.617.2 S_Stab Antigen Preparation of LNP Formulated mRNA Vaccine:

mRNA constructs encoding stabilized Spike (S_stab) of delta variant (B1.617.2) were prepared as described in Example 1.2 (RNA in vitro transcription). As indicated in Tables 4 and 11, in some constructs, uridine was replaced Pseudouridine (ψ) or by 1-Methylpseudouridinie (m1ψ). HPLC purified mRNA was formulated with LNPs according to Example 1.4 prior to use in in vivo vaccination experiments.

Immunization:

Wistar rats (n=8) were injected intramuscularly (i.m.) with mRNA vaccine compositions and doses as indicated in Table 13. As a negative control, one group of rats was vaccinated with buffer (group 1, n=6). All animals were vaccinated on day 0 and day 21. Blood samples were collected on day 21 (post prime) and 42 (post boost) for the determination of antibody titers.

TABLE 16

Vaccination regimen (Example 11):

| Group | Vaccine composition | mRNA ID | CDS opt. | SEQ ID NO: Protein | SEQ ID NO: RNA | Dose |
|---|---|---|---|---|---|---|
| 1 | buffer | | — | — | — | — |
| 2 | CV2CoV.617.2 (delta variant S) | R10630 | opt1 | 27095 | 27394 | 2 μg |
| 3 | CV2CoV.617.2 (delta variant S) | R10630 | opt1 | 27095 | 27394 | 8 μg |
| 4 | CV2CoV.617.2 (delta variant S) | R10630 | opt1 | 27095 | 27394 | 20 μg |
| 5 | CVCoV.617.2 w/o hsl (delta variant S) | R10824 | opt1 | 27095 | 27532 | 2 μg |
| 6 | CVCoV.617.2 w/o hsl (delta variant S) | R10824 | opt1 | 27095 | 27532 | 8 μg |
| 7 | CVCoV.617.2 w/o hsl (delta variant S) | R10824 | opt1 | 27095 | 27532 | 20 μg |
| 8 | CV2CoV.617.2 (delta variant S) ψ | R10827 | opt1 | 27095 | 28762 | 2 μg |
| 9 | CV2CoV.617.2 (delta variant S) ψ | R10827 | opt1 | 27095 | 28762 | 8 μg |
| 10 | CV2CoV.617.2 (delta variant S) ψ | R10827 | opt1 | 27095 | 28762 | 20 μg |
| 11 | CV2CoV.617.2 (delta variant S) m1ψ | R10828 | opt1 | 27095 | 28762 | 2 μg |
| 12 | CV2CoV.617.2 (delta variant S) m1ψ | R10828 | opt1 | 27095 | 28762 | 8 μg |
| 13 | CV2CoV.617.2 (delta variant S) m1ψ | R10828 | opt1 | 27095 | 28762 | 20 μg |

CV2CoV.617.2 is shown as R10630, CVCoV.617.2 w/o hsl as R10824, CV2CoV.617.2 ψ as R10827 and CV2CoV.617.2 m1ψ as R10828 in Table 4. For R10827 uridine was replaced by ψ (pseudouridinie) and for R10828 uridine was replaced by m1ψ (1-methylpseudouridinie).

Determination of total IgG spike-binding antibody titers using ELISA and determination of VNTs were performed as described in Example 2. Recombinant SARS-CoV-2 spike B.1.617.2 RBD protein (L452R,T478K, delta variant) was used for ELISA IgG determination. (for VNTs against delta B.1.617.2 the following strain was used: Lineage: Delta-B.1.617.2, Strain: hCoV-19/France/IDF-APHP-HEGP-20-23-2131905084/2021|EPI_ISL_2029113|2021-04-27 (T19R E156G d157F d158R L452R T478K D614G P681R D950N).

Figure 12:
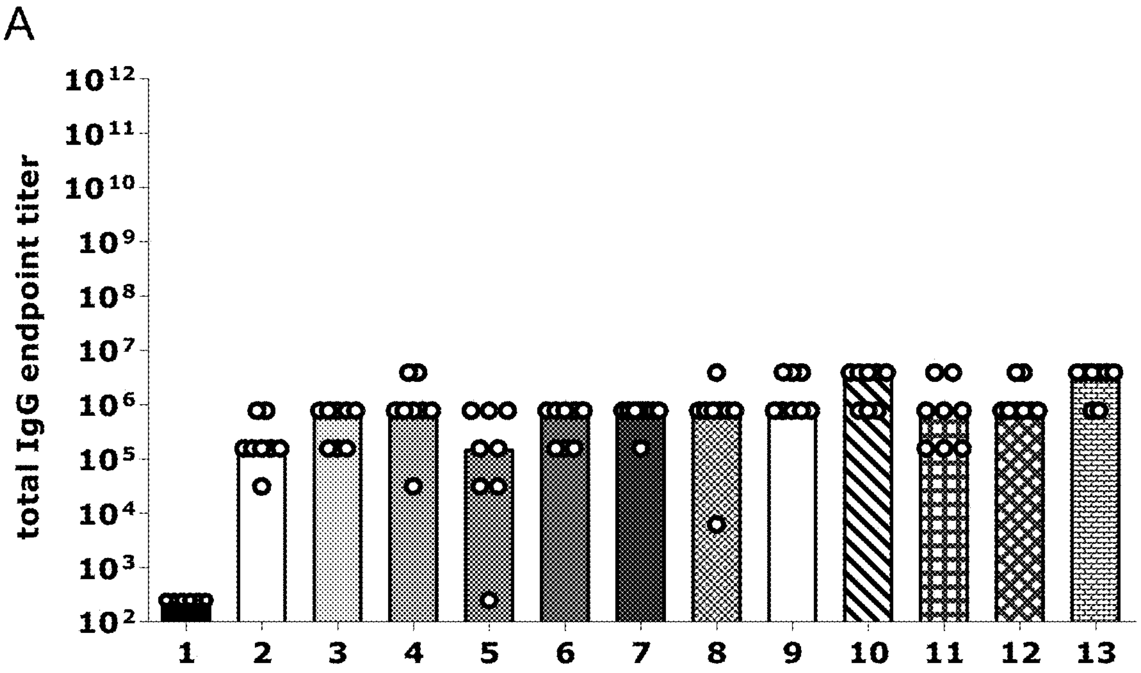
FIG. 12 shows antibody responses upon vaccination with vaccine compositions encoding different mRNA formats of stabilized spike (S_stab pp) of delta variant SARS-CoV-2 B1.617.2 in rats (FIGS. 12A and 12 B: Spike-binding antibodies detected via ELISA against delta B.1.617.2 variant RBD on day 14 and day 42, respectively.
Figure 12:
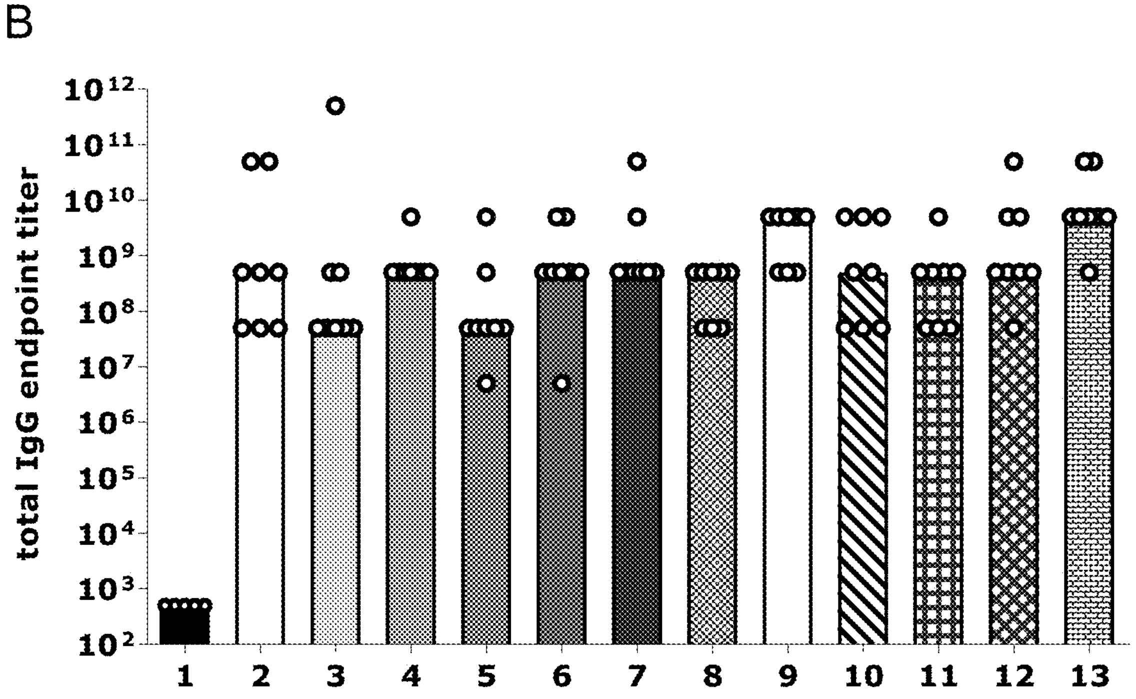
Figure 12:
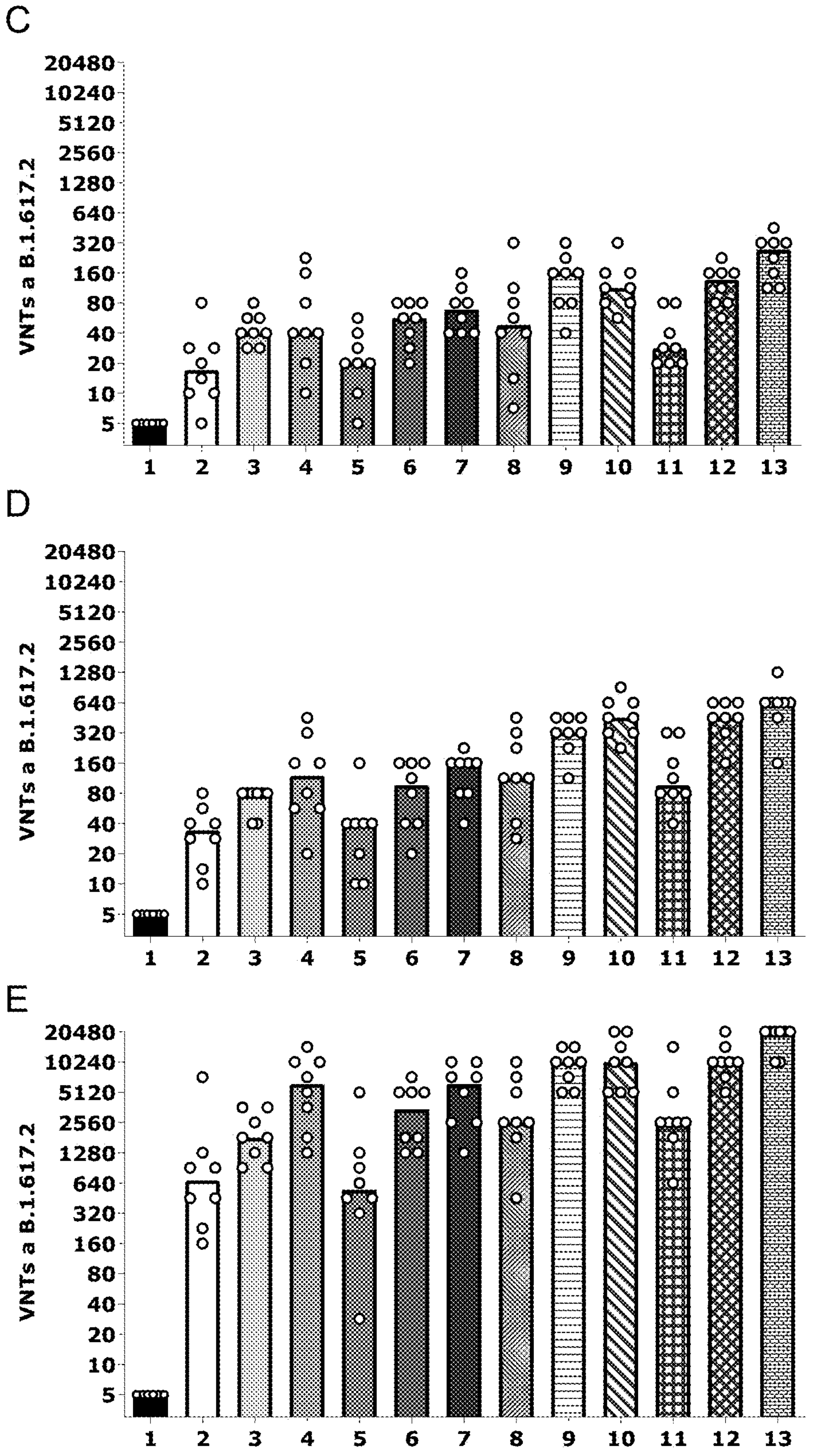
Figure 12:
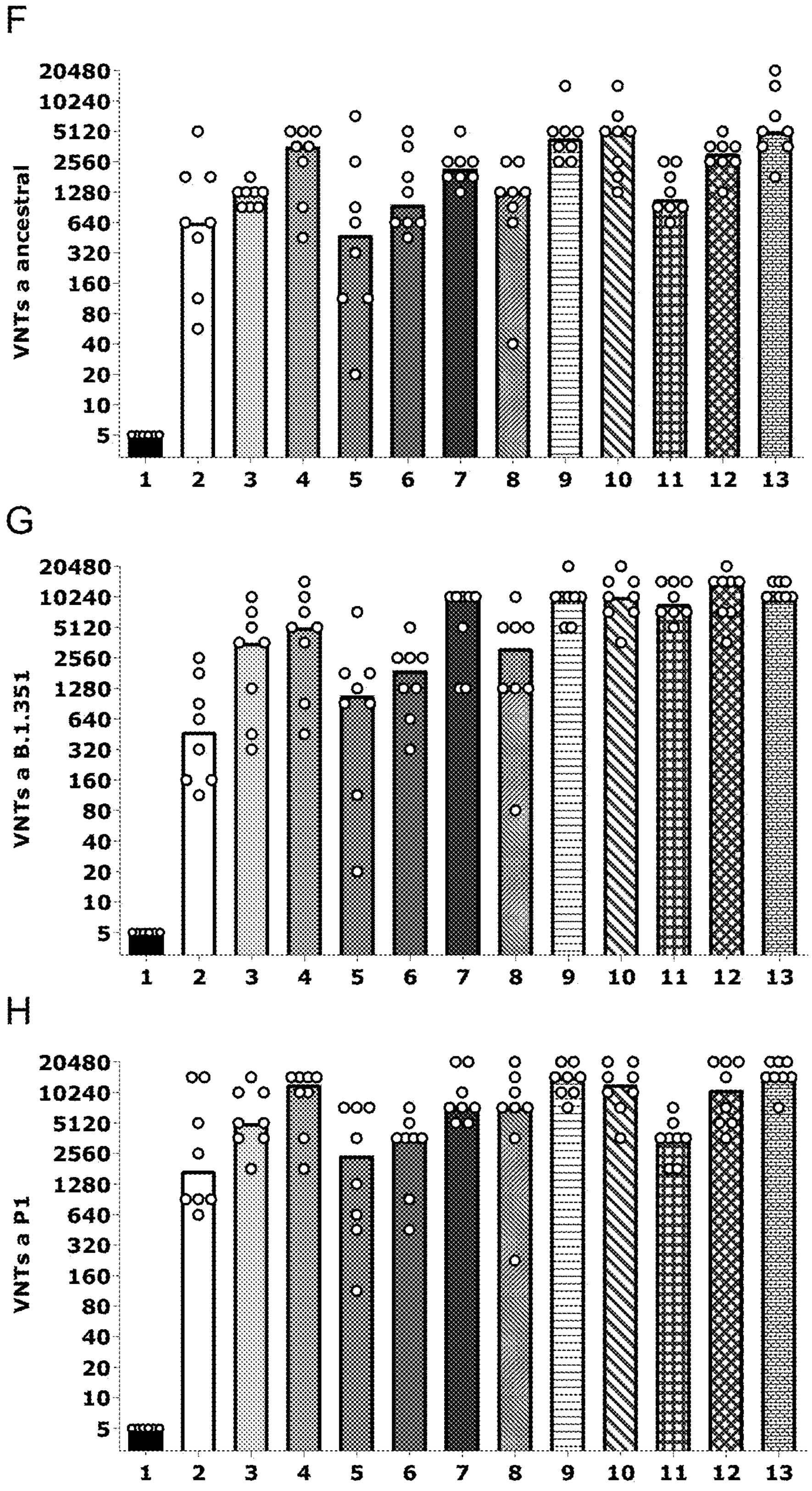

Results:

As shown in FIGS. 12A and B vaccination with different mRNA formats encoding full length S stabilized protein (delta variant B1.617.2) formulated in LNPs induced in rats significant levels of spike-binding antibody titers on day 14 and day 42 using doses of 2 μg, 8 μg, and 20 μg. The second vaccination led to a further increase of antibody titers. Robust VNTs were induced against SARS-CoV-2 variant B1.617.2 in a dose dependent manner for the 2, 8, and 20 μg groups that increasing over time. VNTs were detectable as early as d14 post first injection for all groups including the 2 μg dose (FIG. 12A, day 14), FIG. 12 B (day 21), and FIG. 12 C (day 42). Robust heterologous VNTs against ancestral SARS-CoV-2 (FIG. 12F), against SARS-CoV-2 variant B.1.351 (FIG. 12G), and against SARS-CoV-2 variant P.1 (FIG. 12H) were induced too.

The results demonstrate that the introduction of natural nucleotides (groups 2-7) or chemically modified nucleotides ((ψ (pseudouridinie, groups 8-10) or m1ψ (1-methylpseudouridinie, groups 11-13)) into the mRNA constructs induce comparable levels of VNTs against different variants on day 42, with a trend to improved VNTs by using chemically modified nucleotides (groups 8-13).

Example 12: Multivalency Study in Rats: Immunogenicity of a Bivalent Vaccine Compositions Upon i.m. Administration in Wistar Rats In this study, humoral immunogenicity induced by different LNP-formulated bivalent mRNA vaccine compositions was evaluated in Wistar rats.

Preparation of LNP Formulated mRNA Vaccine:

SARS-CoV-2 mRNA constructs (mRNA based SARS-CoV-2 encoding for full length, pre-fusion stabilized variant SARS-CoV-2 S) were prepared as described in Example 1.2 (RNA in vitro transcription). HPLC purified mRNA was formulated with LNPs according to Example 1.4 and Example 1.5 (separately mixed or formulated for bivalent mRNA vaccines) prior to use in in vivo vaccination experiments.

Immunization:

Rats were injected intramuscularly (i.m.) with bivalent mRNA vaccine compositions and doses as indicated in Table 6. Buffer vaccinated animals served as a negative control (group 1). All animals were vaccinated on day 0 and day 21. Blood samples were collected on day 14, day 21 and day 42 for the determination of humoral immune responses.

TABLE 17

Vaccination regimen (Example 12)

| Group | Animals | Vaccine composition | mRNA ID | SEQ ID NO: Protein | SEQ ID NO: RNA | Dose | Immunisation schedule | Serum isolation |
|---|---|---|---|---|---|---|---|---|
| 1 | N = 4 | Neg control (buffer) | | — | — | — | D 0<br>D 21 | D 1<br>D 14 |
| 2 | Wistar | CV2CoV.617.2 | R10630 | 27095 | 27394 | 8 μg | | D 21 |
| 3 | Female | CV2CoV.617.2 m1ψ | R10828 | 27095 | 28762 | 8 μg | | D 42 |
| 4 | N = 6 | CV2CoV + CV2CoV.617.2 | R9709 + R10630 | 10 + 27095 | 149 + 27394 | 8 μg | | |
| 5 | | CV2CoV m1ψ. + CV2CoV.617.2 m1ψ | R10159 + R10828 | 10 + 27095 | 149 + 28762 | 8 μg | | |
| 6 | | CV2CoV.351 + CV2CoV.617.2 | R10384 + R10630 | 22961 + 27095 | 23531 + 27394 | 8 μg | | |
| 7 | | CV2CoV D614G + CV2CoV.617.2 | R10166 + R10630 | 22738 + 27095 | 22792 + 27394 | 8 μg | | |
| 8 | | CV2CoV D614G m1ψ + CV2CoV.617.2 m1ψ | R10813 + + R10828 | 22738 27095 | 28737 + 28762 | 8 μg | | |

For some constructs, uridine was replaced by m1ψ (1-methylpseudouridinie): R10828, R10159, R10813. Determination of total IgG spike-binding antibody titers using ELISA was performed as described in Example 2. Recombinant Spike RBD protein of ancestral SARS-CoV-2, RBD of variant B.1.617.2 (L452R, T478K: delta), or RBD of B.1.351 (K417N, E484K, N501Y: beta) was used for coating.

Figure 13:
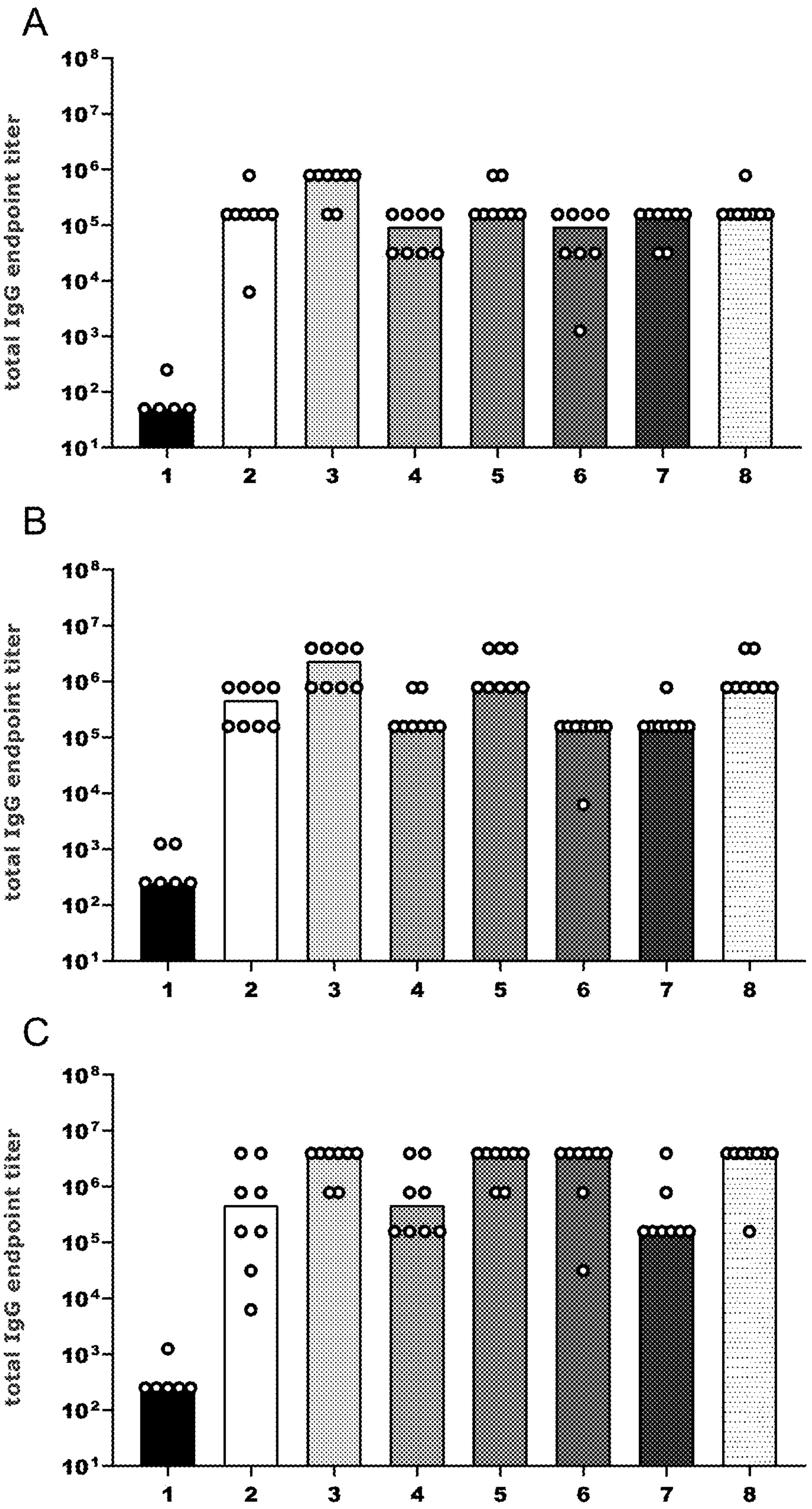
FIG. 13 shows early antibody responses (total IgG) on day 14 upon vaccination with vaccine compositions encoding different mRNA construct encoding S_stab pp of different variant SARS-CoV-2 in rats. Furthermore, the bivalent approaches compare chemically modified mRNA with non-modified mRNA (FIG. 13A: ancestral RBD.

Results:

Vaccination with bivalent vaccine compositions comprising different mRNA formats comprising natural or chemically modified nucleotides (m1ψ (1-methylpseudouridinie)) encoding full length stabilized Spike protein of different variants (for more details see Table 17) formulated in LNPs induced in rats robust and high levels of spike-binding antibody titers on day 14. FIG. 13 demonstrates homologous as well as heterologous responses. (FIG. 13A: ancestral SARS-CoV-2 RBD; FIG. 13 B: B.1.617.2 RBD (L452R, T478K, delta); FIG. 13 C: B.1.351 RBD (K417N, E484K, N501Y, beta). The constructs with modified nucleotides induce higher total IgG titer than constructs with natural nucleotides, for homologous as well as for heterologous responses.

Example 13: Challenge Study in k18-hACE2 Mice with SARS-CoV-2 B.1.351 and B.1.617.2

Generally, Mice are not Susceptible to Infection with SARS-CoV-2, but a Genetically Engineered Mouse Model has been developed that expresses the human receptor ACE2 (hACE2), required for entry of the virus into the host cell under the K18 promoter. The model was originally developed to investigate the causative agent of SARS (SARS-CoV) (MCCRAY, Paul B., et al. Lethal infection of K18-hACE2 mice infected with severe acute respiratory syndrome coronavirus. Journal of virology, 2007, 81. Jg., Nr. 2, S. 813-821) but is now also used as a suitable small animal model for COVID-19. Previously, hACE2 mice have been shown to be susceptible to SARS-CoV-2 and to exhibit a disease course with weight loss, pulmonary pathology, and symptoms similar to those in humans (e.g. BAO, Linlin, et al. The pathogenicity of SARS-CoV-2 in hACE2 transgenic mice. Nature, 2020, 583. Jg., Nr. 7818, S. 830-833, or YINDA, Claude Kwe, et al. K18-hACE2 mice develop respiratory disease resembling severe COVID-19. PLoS pathogens, 2021, 17. Jg., Nr. 1, S. e1009195; DE ALWIS, Ruklanthi M., et al. A Single Dose of Self-Transcribing and Replicating RNA Based SARS-CoV-2 Vaccine Produces Protective Adaptive Immunity In Mice. BioRxiv, 2020.). In principle, the K18-hACE2 mouse is suitable for vaccine studies to investigate the prevention of infection with SARS-CoV-2 or SARS-CoV-2 variants or the reduction of viral load, and at the same time to investigate the correlates and causes of a protective effect of an mRNA vaccine against COVID-19 with well-established immunological methods, which are generally available for mouse models.

The present example shows that SARS-CoV-2 variant S mRNA vaccines are able to protect K18-hACE2 mice from SARS-CoV-2 viral challenge, which can be shown e.g. by measuring the viral loads of infected animals, by monitoring the disease progression with weight loss, pulmonary pathology and other symptoms, or by histopathology and survival.

Preparation of LNP Formulated mRNA Vaccine:

mRNA constructs for SARS-CoV-2 vaccine were prepared as described in Example 1.2 (RNA in vitro transcription). HPLC purified mRNA was formulated with LNPs according to Example 1.4 and Example 1.5 (separately mixed or formulated for bivalent mRNA vaccines) prior to use in in vivo vaccination experiments.

Immunization and Challenge:

K18-hACE2 transgenic mice (female, n=2×10) were injected intramuscularly (i.m.) with mRNA vaccine compositions as indicated in Table 18 (group 1-4). As a negative control, one group of mice was treated with buffer (group 5). The animals were vaccinated on day 0 and day 28 with indicated doses at a volume of 20 µl. Blood samples were collected on day 0, day 28 (post prime), day 56 (post boost) and day 66 (post challenge) for the determination of antibody titers. The animals were challenged/infected i.n. with SARS-CoV-2 virus (($10^{4.375}$TCID$_{50}$ per mouse SARS-CoV-2 B.1.351 and $10^{4.375}$ TCID$_{50}$ SARS-CoV-2 B.1.617.2, calculated from back titration of the original material) on day 56 and monitored for 10 days for changes in body weight, general health and survival, which indicates protection from challenge. Additional parameters of protection include reduced viral loads in lungs and other organs and reduced pathology of the lung. RNA extraction and RT-qPCR and sgRNA RT-PCR was performed as described in Hoffmann et al 2021 (Hoffmann, D., Corleis, B., Rauch, S. et al. CVnCoV and CV2CoV protect human ACE2 transgenic mice from ancestral B BavPat1 and emerging B.1.351 SARS-CoV-2. Nat Commun 12, 4048 (2021)).

RBD Antibody Enzyme-Linked Immunosorbent Assay (ELISA)

Sera were analyzed using an indirect multi-species ELISA based on the RBD (ancestral) of SARS-CoV-2. For this, ELISA plates (Greiner Bio-One GmbH) were coated with 100 ng/well the RBD overnight at 4° C. in 0.1 M carbonate buffer (1.59 g $Na_2CO_3$ and 2.93 g $NaHCO_3$, ad. 1L aqua dest., pH9.6) or were treated with the coating buffer only. Afterwards, the plates were blocked for 1h at 37° C. using 5% skim milk in PBS. Sera were pre-diluted 1/100 in TBS-Tween (TBST) and incubated on the coated and uncoated wells for 1 h at RT. A multi-species conjugate (SBVMILK; obtained from ID Screen® Schmallenberg virus Milk Indirect ELISA; IDvet) was diluted 1/80 and then added for 1 h at RT. Following the addition of tetramethylbenzidine substrate (IDEXX), the ELISA readings were taken at a wavelength of 450 nm on a Tecan Spectra Mini instrument (Tecan Group Ltd.). Between each step, the plates were washed three times with TBST. The absorbance was calculated by subtracting the optical density measured on the uncoated wells from the values obtained from the protein-coated wells for the respective sample. Of note, the ELISA determines relative abundance of anti-RBD Ig levels and therefore does not allow a direct comparison between different studies.

Virus Neutralization Test (VNT)

Sera were pre-diluted 1/16 or 1/32-with DMEM in a 96 well deep well master plate. In three replicate studies, 100 µl of this pre-diluted samples were transferred into a 96 well plate. A log 2 dilution was conducted by passaging 50 µl of the serum dilution in 50 µl DMEM, leaving 50 µl of sera dilution in each well. Subsequently 50 µl of the respective SARS-CoV-2 (B.1.351 or B.1.617.2) virus dilution (100 TCID50/well) was added to each well and incubated for 1 hour at 37° C. Lastly, 100 µl of trypsinated VeroE6 cells (cells of one confluent TC175 flask per 100 ml) in DMEM with 1% penicillin/streptomycin supplementation was added to each well. After 72 hours incubation at 37° C., the wells were evaluated by light microscopy. A serum dilution was counted as neutralizing in the case no specific CPE was visible. The virus titer was confirmed by virus titration, positive and negative serum samples were included.

Results:

Vaccine efficacy was tested by challenging mice with either SARS-CoV-2 variant B.1.351 or SARS-CoV-2 variant B.1.627.2. As shown in FIG. 14, mice of all vaccination groups (group1-4) benefit from vaccination with composition comprising mRNA encoding SARS-CoV-2 ancestral or variant Spike proteins. FIGS. 14A and B demonstrate survival of challenged mice in days post infection/challenge (FIG. 14A: challenge with B.1.351, FIG. 14 B: challenge with B.1.617.2). Vaccination with all tested mRNA vaccines resulted in complete protection of mice (100% survival) against both tested SARS-CoV-2 variants, irrespective of encoded spike variant (group 1: ancestral, group 2: B.1.351, group 3 B.1.617.2, group 4 B.1.351+3 B.1.617.2). FIGS. 14 C and D demonstrate the percentage body weight changes in days post infection/challenge (FIG. 14 C: challenge with B.1.351, FIG. 14 D: challenge with B.1.617.2, mean percentage body weight). Mice of all vaccination groups (group 1-4) did not show significant weight loss.

To investigate whether the vaccination prevented productive infection or dissemination of replicating SARS-CoV-2, oral swabs were taken on day 4 post infection to monitor

TABLE 18

Vaccination regimen (Example 13):

| Group | Vaccine composition | mRNA ID | 5'-UTR/ 3'-UTR; UTR Design | 3'-end | SEQ ID NO: Protein | SEQ ID NO: RNA | Dose |
| --- | --- | --- | --- | --- | --- | --- | --- |
| 1 | CV2CoV | R9709 | HSD17B4/ PSMB3; a-1 | hSL-A100 | 10 | 149 | 0.5 µg |
| 2 | CV2CoV.351 | R10384 | HSD17B4/ PSMB3; a-1 | hSL-A100 | 22961 | 23531 | 0.5 µg |
| 3 | CV2CoV.617.2 | R10630 | HSD17B4/ PSMB3; a-1 | hSL-A100 | 27095 | 27394 | 0.5 µg |
| 4 | CV2CoV.351 + CV2CoV.617.2 | R10384 + R10630 | HSD17B4/ PSMB3; a-1 | hSL-A100 | 22961 + 27095 | 23531 + 27394 | 0.25 µg + 0.25 µg |
| 5 | NaCl buffer | | | | | | |

viral RNA load in saliva. In the sham group, 8/9 or 6/9 samples were positive for viral genome after infection with SARS-CoV-2 variant B.1.351 or SARS-CoV-2 B.1.617.2, respectively (FIG. 14 E: B.1.351 challenge group, FIG. 14 F: B.1.617.2 challenge group). In contrast, after mRNA vaccination, no viral genomes were detected in oral swabs of either challenge groups irrespective of the vaccine group (only in one mouse of CV2CoV vaccination group viral genomes were detected FIG. 14 E, group 1). To further explore the prevention of viral replication following challenge, viral load in the upper respiratory tract (URT) (conchae) and the lower respiratory tract (LRT) (lung), as well as in the central nervous system (brain, cerebellum/cerebrum) was analyzed 10 days post infection. In mice challenged with SARS-CoV-2 B.1.351, reduction of detectable viral replication was observed in all vaccination groups compared to mice not vaccinated (group 5) in the URT (FIG. 14 G). This effect was more prominent for mice challenged with SARS-CoV-2 variant B.1.617.2 (FIG. 14 H). Mice vaccinated with LNP-mRNA coding for SARS-CoV-2 spike variant B.1.617.2 (group 3) showed no replication in conchae after homologous virus challenge (FIG. 14 H). No animal was positive at a low level for SARS-CoV-2 RNA in the LRT, indicating protection from infection by SARS-CoV-2 variant B.1.351 and SARS-CoV-2 variant B.1.617.2 in all groups (FIGS. 14 I and J, respectively). For the brain, similar results were achieved (FIG. 14 K and L for cerebellum, FIGS. 14 M and N for Cerebrum (for challenge group B.1.351: FIGS. 14 K and M, for B.1.617.2: FIGS. 14 L and N).

The bivalent vaccine (group 4) induced protection against both virus variants (B.1.351 and B.1.617.2) comparable to the monovalent vaccines (groups 1-3) despite using lower doses of each vaccine.

Sera from all vaccinated mice collected on day 28 (only tested for challenge group B.1.351) and day 56 (for both groups) showed a strong induction of anti-RBD total immunoglobulins (Ig), irrespective of which variant spike the mRNA was coding (FIG. 14 O: challenge group B.1.351, FIG. 14 P: challenge group B.1.617.2). The strong induction of anti-RBD antibodies in the mRNA vaccine groups was reflected by high virus neutralization titers (VNT) (FIG. 14 Q: post-challenge group B.1.351, FIG. 14 R: pre-challenge group B.1.617.2, FIG. 14 S: post-challenge group B.1.617.2). Overall, the tested mRNA vaccines induced robust antibody responses in a prime-boost regime, capable of efficiently neutralizing both SARS-CoV-2 variants B.1.351 and SARS-CoV-2 B.1.617.2 in vitro.

Example 14: Challenge Study of Hamsters Vaccinated with CV2CoV or CV2CoV.351

The protective efficacy of LNP-mRNA encoding variant B.1.351 S_stab formulated in LNPs (CV2CoV.351) was addressed in Syrian hamsters. This model represents mild to moderate human lung disease pathology and is one of the recognized and accepted models to investigate human-relevant immunogenicity and pathogenesis (Mũnoz-Fontela et al, PMID 32967005). Hamsters are susceptible to wild-type SARS-CoV-2 infection, resulting in high levels of virus replication and histopathological changes in viral target organs.

Preparation of LNP Formulated mRNA Vaccine:

SARS-CoV-2 S mRNA constructs were prepared as described in Example 1 (RNA in vitro transcription). HPLC purified mRNA was formulated with LNPs according to Example 1.4 prior to use in in vivo vaccination experiments.

Immunization and Challenge:

Syrian golden hamsters (n=9/group) were injected intramuscularly (i.m.) with mRNA vaccine compositions and doses as indicated in Table 19. As negative controls, one group of hamsters was not treated and mock infected (with buffer) (group A), another group was injected with NaCl as a buffer control. The animals were challenged intranasally under a short-term inhalation anaesthesia with 70 μl of SARS-CoV-2 variant B.1.351 using $10^{5.25}$TCID50 per hamster (calculated from back titration of the original material) at day 56. For the days after infection, viral shedding was monitored in addition to a daily physical examination and body weighing routine. To evaluate viral shedding, nasal washes were individually collected from each hamster under a short-term isoflurane anaesthesia. Blood samples were collected on day 28 (post prime), day 55 (post boost) and day 60 (post challenge infection) for the determination of antibody titers.

TABLE 19

Vaccination regimen (Example 14):

| Group | Vaccine composition | mRNA ID | dose | vaccination | SEQ ID NO: Protein | SEQ ID NO: RNA |
|---|---|---|---|---|---|---|
| 1 | NaCl | — | — | d 0, d 28 | | |
| 2 | CV2CoV.351 | R10384 | 1 μg | d 0, d 28 | 22961 | 23531 |
| 3 | CV2CoV.351 | R10384 | 4 μg | d 0, d 28 | 22961 | 23531 |
| 4 | CV2CoV.351 | R10384 | 12 μg | d 0, d 28 | 22961 | 23531 |

Antibody Analysis

Blood samples were taken at days 0, 28, 55, and 60 for the determination of total IgG antibodies via ELISA. Plates were coated with 1 μg/ml of SARS-CoV-2 S ancestral RBD for 4-5h at 37° C. Plates were blocked overnight in 10% milk, washed and incubated with serum for 2 h at room temperature. For detection, hamster sera were incubated with biotin goat anti-hamster (Syrian) IgG antibody (BioLegend, Cat: 405601) followed by incubation with HRP-Streptavidin (BD, Cat: 554066). Detection of specific signals was performed in a BioTek SynergyHTX plate reader, with excitation 530/25, emission detection 590/35 and a sensitivity of 45.

Virus neutralizing antibody titers (VNT) of hamster serum samples were analyzed as described in Example 13 by using only SARS-CoV-2 virus variant B.1.351.

Viral Load in the Respiratory Tract

RNA was isolated from nasal wash over time and from lung tissue samples (cranial, medial, caudal) 4 days post challenge infection. RNA extraction followed by detection of subgenomic RNA (sgRNA) by RT-qPCR was performed as described in Hoffmann et al 2021 (Hoffmann, D., Corleis, B., Rauch, S. et al. CVnCoV and CV2CoV protect human ACE2 transgenic mice from ancestral B BavPat1 and emerging B.1.351 SARS-CoV-2. Nat Commun 12, 4048 (2021)).

Results

Vaccine efficacy was tested by challenging hamsters with $10^{5.25}$ TCID50 dose/hamster of SARS-CoV-2 variant B.1.351. FIG. 15A demonstrates the percentage body weight changes in days post challenge. Mice of all vaccination groups (group 2-4) did not show significant weight loss. The weight of non-treated mice decreased over time down to 90% body weight (group 1).

To investigate whether the vaccination prevented productive infection of SARS-CoV-2, nasal washes were analyzed on days 2, 4, 8, and 12 post infection to monitor viral RNA load of infected animal. In vaccinated groups (groups 2-4), the viral load determined by detecting sgRNA, was slightly reduced compared to the untreated control (group 1) (FIG. 15 B). More prominent, significant reduced viral genomes (by detecting sgRNA) were detected in the lower respiratory tract (LRT) (of cranial, medial, caudal lung lobes) after mRNA vaccination. Only one animal was positive at a low level for SARS-CoV-2 B.1.351 RNA in the 12 μg CV2CoV.351 vaccine group (group 4), indicating protection from infection by SARS-CoV-2 variant B.1.351 (FIG. 15 C).

Sera from mice collected on day 28, day 55 and day 60 showed a strong induction of anti-RBD total immunoglobulins (Ig) (FIG. 15 D). This induction of anti-RBD antibodies in the mRNA vaccine groups was reflected by robust virus neutralization titers (VNT) (see FIG. 15 E (open symbol pre-challenge (day 55), filled symbols post-challenge on day 60). Overall, the tested mRNA vaccines induced robust antibody responses in a prime-boost regime, capable of efficiently neutralizing SARS-CoV-2 variant B.1.351.

Example 15 (Prophetic)

To demonstrate safety and efficiency of the mRNA vaccine composition(s), a clinical trial (phase I) is initiated. In the clinical trial, a cohort of human volunteers is intramuscularly injected for at least two times (e.g. day 0 and day 28) with mRNA encoding variant SARS-CoV-2 spike protein formulated in LNPs according to the invention. In order to assess the safety profile of the vaccine compositions according to the invention, subjects are monitored after administration (vital signs, vaccination site tolerability assessments, hematologic analysis). The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

The invention claimed is:

1. A composition comprising a mRNA comprising:

(a) at least one coding sequence encoding a SARS-CoV-2 spike protein (S) at least 95% identical to SEQ ID NO: 10 that is a pre-fusion stabilized spike protein (S_stab) comprising K986P and V987P stabilizing mutations and S477N, E484A, N501Y, D614G, P681H, H655Y, and G142D amino acid substitutions relative to SEQ ID NO: 10, and at least one of the following further substitutions relative to SEQ ID NO: 10: T191, L24del, P25del, P26del, A27S, S371F, T376A, and/or D405N;

(b) at least one heterologous untranslated region (UTR); and (c) at least one pharmaceutically acceptable carrier, wherein the mRNA is complexed or associated with a lipid nanoparticle (LNP) and wherein the LNP comprises:

(i) at least one cationic lipid;

(ii) at least one neutral lipid;

(iii) at least one steroid or steroid analogue; and (iv) at least one PEG-lipid, wherein (i) to (iv) are in a molar ratio of about 20-60% of the at least one cationic lipid, 5-25% of the at least one neutral lipid, 25-55% of the at least one steroid or steroid analogue, and 0.5-5% of the at least one PEG-lipid.

2. The composition of claim 1, wherein the mRNA comprises at least one poly(A) sequence comprising 30 to 200 adenosine nucleotides and a 5'-cap structure.

3. The composition of claim 1, wherein the at least one coding sequence of the mRNA has a G/C content of at least about 50%.

4. The composition of claim 3, wherein the at least one coding sequence of the mRNA has a G/C content of at least about 55%.

5. The composition of claim 1, wherein the mRNA comprises a sequence at least 90% identical to SEQ ID NO: 28590.

6. The composition of claim 1, wherein the at least one heterologous UTR is selected from at least one heterologous 5'-UTR and/or at least one heterologous 3'-UTR.

7. The composition of claim 6, wherein the at least one heterologous 3'-UTR comprises or consists of a nucleic acid sequence derived from a 3'-UTR of a gene selected from PSMB3, ALB7, alpha-globin, CASP1, COX6B1, GNAS, NDUFA1 and RPS9; or wherein the at least one heterologous 5'-UTR comprises or consists of a nucleic acid sequence derived from a 5'-UTR of a gene selected from HSD17B4, RPL32, ASAH1, ATP5A1, MP68, NDUFA4, NOSIP, RPL31, SLC7A3, TUBB4B and UBQLN2.

8. The composition of claim 1, wherein the mRNA comprises at least one histone stem-loop.

SEQUENCE LISTING (28940 sequences)

SEQ ID NO: 1 - protein, 1273 aa, Artificial Sequence
  SARS-CoV-2/Wuhan/WIV05/2019__EPI_ISL_402128 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2-9 - skipped (8 entries)

SEQ ID NO: 10 - protein, 1273 aa, Artificial Sequence
  SARS-CoV-2/Wuhan/WIV05/2019__EPI_ISL_402128 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 11-26 - skipped (16 entries)

SEQ ID NO: 27 - protein, 681 aa, Artificial Sequence
  SARS-CoV-2/Wuhan/WIV05/2019__EPI_ISL_402128 spike protein (1-681)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 28 - protein, 15 aa, Artificial Sequence
  SARS-CoV-2/Wuhan/WIV05/2019__EPI_ISL_402128 spike protein (1-15)
MFVFLVLLPLVSSQC

SEQ ID NO: 29 - protein, 666 aa, Artificial Sequence
  SARS-CoV-2/Wuhan/WIV05/2019__EPI_ISL_402128 spike protein (16-681)
VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 30 - protein, 592 aa, Artificial Sequence
  SARS-CoV-2/Wuhan/WIV05/2019__EPI_ISL_402128 spike protein (682-1273)
RRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 31 - protein, 1211 aa, Artificial Sequence
  SARS-CoV-2/Wuhan/WIV05/2019__EPI_ISL_402128 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 32-48 - skipped (17 entries)

SEQ ID NO: 49 - protein, 62 aa, Artificial Sequence
  SARS-CoV-2/Wuhan/WIV05/2019__EPI_ISL_402128 spike protein (1212-1273)
WPWYIWLGFIAGLIAIVMVTIMLCCMTSCCSCLKGCCSCGSCCKFDEDDSEPVLKGVKLHYT

SEQ ID NO: 50-115 - skipped (66 entries)

SEQ ID NO: 116 - RNA, 3822 nt, Artificial Sequence
  SARS-CoV-2/Wuhan/WIV05/2019__EPI_ISL_402128 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 117-135 - skipped (19 entries)

SEQ ID NO: 136 - RNA, 3822 nt, Artificial Sequence
  SARS-CoV-2/Wuhan/WIV05/2019__EPI_ISL_402128 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 137 - RNA, 3822 nt, Artificial Sequence
  SARS-CoV-2/Wuhan/WIV05/2019__EPI_ISL_402128 spike protein CDS gc (1-1273)(K986P_V987P)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 138-145 - skipped (8 entries)

SEQ ID NO: 146 - RNA, 3822 nt, Artificial Sequence
  SARS-CoV-2/Wuhan/WIV05/2019__EPI_ISL_402128 spike protein CDS gc mod (1-1273)(K986P_V987P)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 147 - skipped

SEQ ID NO: 148 - RNA, 4094 nt, Artificial Sequence
  SARS-CoV-2/Wuhan/WIV05/2019__EPI_ISL_402128 spike protein mRNA gc (1-1273) R9488, R9492, R10161
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 149 - RNA, 4094 nt, Artificial Sequence
  SARS-CoV-2/Wuhan/WIV05/2019__EPI_ISL_402128 spike protein mRNA gc (1-1273)(K986P_V987P) R9487, R9491, R9709, R10159, R10160, R10727
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 150 - skipped

SEQ ID NO: 151 - RNA, 4094 nt, Artificial Sequence
  SARS-CoV-2/Wuhan/WIV05/2019__EPI_ISL_402128 spike protein mRNA gc mod (1-1273)(K986P_V987P) R10162
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 152-161 - skipped (10 entries)

SEQ ID NO: 162 - RNA, 4039 nt, Artificial Sequence
  SARS-CoV-2/Wuhan/WIV05/2019__EPI_ISL_402128 spike protein mRNA gc (1-1273) R9514
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 163 - RNA, 4039 nt, Artificial Sequence
  SARS-CoV-2/Wuhan/WIV05/2019__EPI_ISL_402128 spike protein mRNA gc (1-1273)(K986P_V987P) R9515, R10157, R10892
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 164 - skipped

SEQ ID NO: 165 - RNA, 4039 nt, Artificial Sequence
  SARS-CoV-2/Wuhan/WIV05/2019__EPI_ISL_402128 spike protein mRNA gc mod (1-1273)(K986P_V987P) R9519
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 166-175 - skipped (10 entries)

SEQ ID NO: 176 - RNA, 6 nt, Artificial Sequence
  mRNA 5'-end
gggaga

SEQ ID NO: 177 - RNA, 6 nt, Artificial Sequence
  mRNA 5'-end
aggaga

SEQ ID NO: 178 - DNA, 24 bp, Artificial Sequence
  histone stem-loop (histoneSL,hSL)
caaaggctcttttcagagccacca

SEQ ID NO: 179 - RNA, 24 nt, Artificial Sequence
  histone stem-loop (histoneSL,hSL) mRNA
caaaggcucuuuucagagccacca

SEQ ID NO: 180 - DNA, 13 bp, Artificial Sequence
  Kozak
gccgccaccatgg

SEQ ID NO: 181 - RNA, 13 nt, Artificial Sequence
  Kozak mRNA
gccgccaccaugg

SEQ ID NO: 182 - RNA, 128 nt, Artificial Sequence
  mRNA 3'-end A64-N5-C30-histoneSL-N5
aaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 183 - RNA, 129 nt, Artificial Sequence
  mRNA 3'-end histoneSL-A100-N5
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaauu

SEQ ID NO: 184 - RNA, 93 nt, Artificial Sequence
  mRNA 3'-end histoneSL-A64-N5
caaaggcucuuuucagagccaccaaaaaaaaaaaaaaaaaaaaaaaaaaaaaaaaaaaaaaaaaaaaaaaaaaaaaaaaaaaaaaaaagaauu

SEQ ID NO: 185 - RNA, 105 nt, Artificial Sequence
  mRNA 3'-end A100-N5
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaauu

SEQ ID NO: 186 - RNA, 69 nt, Artificial Sequence
  mRNA 3'-end A64-N5
aaaaaaaaaaaaaaaaaaaaaaaaaaaaaaaaaaaaaaaaaaaaaaaaaaaaaaaaaaaaaaaagaauu

SEQ ID NO: 187 - RNA, 124 nt, Artificial Sequence
  mRNA 3'-end histoneSL-A100
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 188 - RNA, 88 nt, Artificial Sequence
  mRNA 3'-end histoneSL-A64
caaaggcucuuuucagagccaccaaaaaaaaaaaaaaaaaaaaaaaaaaaaaaaaaaaaaaaaaaaaaaaaaaaaaaaaaaaaaaaaa

SEQ ID NO: 189 - RNA, 100 nt, Artificial Sequence
  mRNA 3'-end A100
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 190 - RNA, 64 nt, Artificial Sequence
  mRNA 3'-end A64
aaaaaaaaaaaaaaaaaaaaaaaaaaaaaaaaaaaaaaaaaaaaaaaaaaaaaaaaaaaaaaaa

SEQ ID NO: 191 - RNA, 93 nt, Artificial Sequence
  mRNA 3'-end A64-histoneSL-N5
aaaaaaaaaaaaaaaaaaaaaaaaaaaaaaaaaaaaaaaaaaaaaaaaaaaaaaaaaaaaaaaacaaaggcucuuuucagagccaccagaauu

SEQ ID NO: 192 - RNA, 134 nt, Artificial Sequence
  mRNA 3'-end N6-A64-N5-C30-histoneSL-N5
auuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 193 - RNA, 134 nt, Artificial Sequence
  mRNA 3'-end N6-A64-N5-C30-histoneSL-N5
agaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 194 - RNA, 135 nt, Artificial Sequence
  mRNA 3'-end N6-histoneSL-A100-N5
auuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaauu

SEQ ID NO: 195 - RNA, 135 nt, Artificial Sequence
  mRNA 3'-end N6-histoneSL-A100-N5
agaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaauu

SEQ ID NO: 196 - RNA, 99 nt, Artificial Sequence
  mRNA 3'-end N6-histoneSL-A64-N5
auuaaucaaaggcucuuuucagagccaccaaaaaaaaaaaaaaaaaaaaaaaaaaaaaaaaaaaaaaaaaaaaaaaaaaaaaaaaaaaaaaaaagaauu

SEQ ID NO: 197 - RNA, 99 nt, Artificial Sequence
  mRNA 3'-end N6-histoneSL-A64-N5
agaucucaaaggcucuuuucagagccaccaaaaaaaaaaaaaaaaaaaaaaaaaaaaaaaaaaaaaaaaaaaaaaaaaaaaaaaaaaaaaaaaagaauu

SEQ ID NO: 198 - RNA, 111 nt, Artificial Sequence
  mRNA 3'-end N6-A100-N5
auuaauaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaauu

SEQ ID NO: 199 - RNA, 111 nt, Artificial Sequence
  mRNA 3'-end N6-A100-N5
agaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaauu

SEQ ID NO: 200 - RNA, 75 nt, Artificial Sequence
  mRNA 3'-end N6-A64-N5
auuaauaaaaaaaaaaaaaaaaaaaaaaaaaaaaaaaaaaaaaaaaaaaaaaaaaaaaaaaaaaaaaaaagaauu

SEQ ID NO: 201 - RNA, 75 nt, Artificial Sequence
  mRNA 3'-end N6-A64-N5
agaucuaaaaaaaaaaaaaaaaaaaaaaaaaaaaaaaaaaaaaaaaaaaaaaaaaaaaaaaaaaaaaaaagaauu

SEQ ID NO: 202 - RNA, 130 nt, Artificial Sequence
  mRNA 3'-end N6-histoneSL-A100
auuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 203 - RNA, 130 nt, Artificial Sequence
  mRNA 3'-end N6-histoneSL-A100
agaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 204 - RNA, 94 nt, Artificial Sequence
  mRNA 3'-end N6-histoneSL-A64
auuaaucaaaggcucuuuucagagccaccaaaaaaaaaaaaaaaaaaaaaaaaaaaaaaaaaaaaaaaaaaaaaaaaaaaaaaaaaaaaaaaaa

SEQ ID NO: 205 - RNA, 94 nt, Artificial Sequence
  mRNA 3'-end N6-histoneSL-A64
agaucucaaaggcucuuuucagagccaccaaaaaaaaaaaaaaaaaaaaaaaaaaaaaaaaaaaaaaaaaaaaaaaaaaaaaaaaaaaaaaaaa

SEQ ID NO: 206 - RNA, 106 nt, Artificial Sequence
  mRNA 3'-end N6-A100
auuaauaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 207 - RNA, 106 nt, Artificial Sequence
  mRNA 3'-end N6-A100
agaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 208 - RNA, 70 nt, Artificial Sequence
  mRNA 3'-end N6-A64
auuaauaaaaaaaaaaaaaaaaaaaaaaaaaaaaaaaaaaaaaaaaaaaaaaaaaaaaaaaaaaaaaaaa

SEQ ID NO: 209 - RNA, 70 nt, Artificial Sequence
  mRNA 3'-end N6-A64
agaucuaaaaaaaaaaaaaaaaaaaaaaaaaaaaaaaaaaaaaaaaaaaaaaaaaaaaaaaaaaaaaaaa

SEQ ID NO: 210 - RNA, 99 nt, Artificial Sequence
  mRNA 3'-end N6-A64-histoneSL-N5
auuaauaaaaaaaaaaaaaaaaaaaaaaaaaaaaaaaaaaaaaaaaaaaaaaaaaaaaaaaaaaaaaaaacaaaggcucuuuucagagccaccagaauu

SEQ ID NO: 211 - RNA, 99 nt, Artificial Sequence
  mRNA 3'-end N6-A64-histoneSL-N5
agaucuaaaaaaaaaaaaaaaaaaaaaaaaaaaaaaaaaaaaaaaaaaaaaaaaaaaaaaaaaaaaaaaacaaaggcucuuuucagagccaccagaauu

SEQ ID NO: 212 - RNA, 110 nt, Artificial Sequence
  mRNA 3'-end N12-A64-N5-histoneSL-N5
auuaauagaucuaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 213 - RNA, 110 nt, Artificial Sequence; identical to SEQ ID NO: 212
  mRNA 3'-end N12-A64-N5-histoneSL-N5

SEQ ID NO: 214 - RNA, 99 nt, Artificial Sequence
  mRNA 3'-end A75-histoneSL
aaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 215 - RNA, 102 nt, Artificial Sequence
  mRNA 3'-end U3-A75-histoneSL
uuuaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 216 - RNA, 178 nt, Artificial Sequence
  mRNA 3'-end A154-histoneSL
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 217 - RNA, 181 nt, Artificial Sequence
  mRNA 3'-end U3-A154-histoneSL
uuuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 218 - RNA, 101 nt, Artificial Sequence
  mRNA 3'-end N2-A75-histoneSL
agaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 219 - RNA, 99 nt, Artificial Sequence
  mRNA 3'-end histoneSL-A75
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaa

SEQ ID NO: 220 - RNA, 170 nt, Artificial Sequence
  mRNA 3'-end histoneSL-A146
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 221 - RNA, 136 nt, Artificial Sequence
  mRNA 3'-end N8-A64-N5-C30-histoneSL-N5
agauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 222 - RNA, 131 nt, Artificial Sequence
  mRNA 3'-end N8-A64-N5-C30-histoneSL
agauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccacca

SEQ ID NO: 223 - RNA, 105 nt, Artificial Sequence
  mRNA 3'-end N8-A64-N5-C4-histoneSL
agauuaauaaaaaaaaaaaaaaaaaaaaaaaaaaaaaaaaaaaaaaaaaaaaaaaaaaaaaaaaaaaaaaaaugcaucccccaaaggcucuuuucagagccacca

SEQ ID NO: 224 - RNA, 115 nt, Artificial Sequence
  mRNA 3'-end N8-A64-N5-C14-histoneSL
agauuaauaaaaaaaaaaaaaaaaaaaaaaaaaaaaaaaaaaaaaaaaaaaaaaaaaaaaaaaaaaaaaaaaugcaucccccccccccccccaaaggcucuuuucagagccacca

SEQ ID NO: 225 - RNA, 129 nt, Artificial Sequence
  mRNA 3'-end N6-A64-N5-C30-histoneSL
agaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccacca

SEQ ID NO: 226 - RNA, 103 nt, Artificial Sequence
  mRNA 3'-end N6-A64-N5-C4-histoneSL
agaucuaaaaaaaaaaaaaaaaaaaaaaaaaaaaaaaaaaaaaaaaaaaaaaaaaaaaaaaaaaaaaaaaugcaucccccaaaggcucuuuucagagccacca

SEQ ID NO: 227 - RNA, 113 nt, Artificial Sequence
  mRNA 3'-end N6-A64-N5-C14-histoneSL
agaucuaaaaaaaaaaaaaaaaaaaaaaaaaaaaaaaaaaaaaaaaaaaaaaaaaaaaaaaaaaaaaaaaugcaucccccccccccccccaaaggcucuuuucagagccacca

SEQ ID NO: 228 - RNA, 123 nt, Artificial Sequence
  mRNA 3'-end A64-N5-C30-histoneSL
aaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccacca

SEQ ID NO: 229 - RNA, 97 nt, Artificial Sequence
  mRNA 3'-end A64-N5-C4-histoneSL
aaaaaaaaaaaaaaaaaaaaaaaaaaaaaaaaaaaaaaaaaaaaaaaaaaaaaaaaaaaaaaaaugcaucccccaaaggcucuuuucagagccacca

SEQ ID NO: 230 - RNA, 107 nt, Artificial Sequence
  mRNA 3'-end A64-N5-C14-histoneSL
aaaaaaaaaaaaaaaaaaaaaaaaaaaaaaaaaaaaaaaaaaaaaaaaaaaaaaaaaaaaaaaaugcaucccccccccccccccaaaggcucuuuucagagccacca

SEQ ID NO: 231 - DNA, 62 bp, Artificial Sequence
  HSD17B4 5'-UTR
gtcccgcagtcggcgtccagcggctctgcttgttcgtgtgtgtgtcgttgcaggccttattc

SEQ ID NO: 232 - RNA, 62 nt, Artificial Sequence
  HSD17B4 5'-UTR
gucccgcagucggcguccagcggcucugcuuguucgugugugugucguugcaggccuuauuc

SEQ ID NO: 233 - DNA, 42 bp, Artificial Sequence
  ASAH1 5'-UTR
gcctctgctggagtccggggagtggcgttggctgctagagcg

SEQ ID NO: 234 - RNA, 42 nt, Artificial Sequence
  ASAH1 5'-UTR
gccucugcuggaguccggggaguggcguuggcugcuagagcg

SEQ ID NO: 235 - DNA, 75 bp, Artificial Sequence
  ATP5A1 5'-UTR
gcggctcggccattttgtcccagtcagtccggaggctgcggctgcagaagtaccgcctgcggagtaactgcaaag

SEQ ID NO: 236 - RNA, 75 nt, Artificial Sequence
  ATP5A1 5'-UTR
gcggcucggccauuuugucccagucaguccggaggcugcggcugcagaaguaccgccugcggaguaacugcaaag

SEQ ID NO: 237 - DNA, 54 bp, Artificial Sequence
  Mp68_(2010107E04Rik) 5'-UTR
ctttcccattctgtagcagaatttggtgttgcctgtggtcttggtcccgcggag

SEQ ID NO: 238 - RNA, 54 nt, Artificial Sequence
  Mp68_(2010107E04Rik) 5'-UTR
cuuucccauucuguagcagaauuugguguugccuguggucuuggucccgcggag

SEQ ID NO: 239 - DNA, 81 bp, Artificial Sequence
  Ndufa4 5'-UTR
gtccgctcagccaggttgcagaagcggcttagcgtgtgtcctaatcttctctctgcgtgtaggtaggcctgtgccgcaaac

SEQ ID NO: 240 - RNA, 81 nt, Artificial Sequence
  Ndufa4 5'-UTR
guccgcucagccagguugcagaagcggcuuagcguguguccuaaucuucucucugcguguagguaggccugugccgcaaac

SEQ ID NO: 241 - DNA, 108 bp, Artificial Sequence
  Nosip 5'-UTR
ctcctgtcgggcggaagtaggaggagtagagtttaaaaacagtactctttttccggttcgggacgtagttgaagcaacgacaagccggataaccgctcttgagacagg

SEQ ID NO: 242 - RNA, 108 nt, Artificial Sequence
  Nosip 5'-UTR
cuccugucgggcggaaguaggaggaguagaguuuaaaaacaguacucuuuuuccgguucgggacguaguugaagcaacgacaagccggauaaccgcucuugagacagg

SEQ ID NO: 243 - DNA, 84 bp, Artificial Sequence
  Rpl31 5'-UTR
cccgtgacccggaagttgtacggctacgcgactttccctcccacaaaccctcgcgcccttcctttcctacttgggcccggcaga

SEQ ID NO: 244 - RNA, 84 nt, Artificial Sequence
  Rpl31 5'-UTR
cccgugacccggaaguuguacggcuacgcgacuuucccucccacaaacccucgcgcccuuccuuuccuacuugggcccggcaga

SEQ ID NO: 245 - DNA, 159 bp, Artificial Sequence
  Slc7a3 5'-UTR
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 246 - RNA, 159 nt, Artificial Sequence
  Slc7a3 5'-UTR
gggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuaga

SEQ ID NO: 247 - DNA, 102 bp, Artificial Sequence
  TUBB4B 5'-UTR
atataagcgttggcggagcgtcggttgtagcactctgcgcgcccgctcttctgctgctgtttgtctacttcctcctgcttccccgccgccgccgccgccatc

SEQ ID NO: 248 - RNA, 102 nt, Artificial Sequence
  TUBB4B 5'-UTR
auauaagcguuggcggagcgucgguuguagcacucugcgcgcccgcucuucugcugcuguuugucuacuuccuccugcuuccccgccgccgccgccgccauc

SEQ ID NO: 249 - DNA, 222 bp, Artificial Sequence
  Ubqln2 5'-UTR
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 250 - RNA, 222 nt, Artificial Sequence
  Ubqln2 5'-UTR
cggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgcc

SEQ ID NO: 251 - DNA, 42 bp, Artificial Sequence
  RPL32_(32L4,32L3) 5'-UTR
ggcgctgcctacggaggtggcagccatctccttctcggcatc

SEQ ID NO: 252 - RNA, 42 nt, Artificial Sequence
  RPL32_(32L4,32L3) 5'-UTR
ggcgcugccuacggagguggcagccaucuccuucucggcauc

SEQ ID NO: 253 - DNA, 57 bp, Artificial Sequence
  PSMB3 3'-UTR
ccctgttcccagagcccacttttttttctttttttgaaataaaatagcctgtctttc

SEQ ID NO: 254 - RNA, 57 nt, Artificial Sequence
  PSMB3 3'-UTR
cccuguucccagagcccacuuuuuuuucuuuuuuugaaauaaaauagccugucuuuc

SEQ ID NO: 255 - DNA, 121 bp, Artificial Sequence
  CASP1 3'-UTR
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 256 - RNA, 121 nt, Artificial Sequence
  CASP1 3'-UTR
aauaaggaaacuguaugaaugucugugggcaggaagugaagagauccuucuguaaagguuuuuggaauuaugucugcugaauaauaaacuuuuuugaaauaauaaaucugguagaaaaaug

SEQ ID NO: 257 - DNA, 137 bp, Artificial Sequence
  COX6B1 3'-UTR
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 258 - RNA, 137 nt, Artificial Sequence
  COX6B1 3'-UTR
acuggcugcaucucccuuuccucuguccuccauccuucucccaggauggugaagggggaccugguacccagugauccccaccccaggauccuaaaucaugacuuaccugcuaauaaaaacucauuggaaaagugaga

SEQ ID NO: 259 - DNA, 353 bp, Artificial Sequence
  Gnas 3'-UTR
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 260 - RNA, 353 nt, Artificial Sequence
  Gnas 3'-UTR
gaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagca

SEQ ID NO: 261 - DNA, 133 bp, Artificial Sequence
  Ndufa1 3'-UTR
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 262 - RNA, 133 nt, Artificial Sequence
  Ndufa1 3'-UTR
ggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaa

SEQ ID NO: 263 - DNA, 70 bp, Artificial Sequence
  RPS9 3'-UTR
gtccacctgtccctcctgggctgctggattgtctcgttttcctgccaaataaacaggatcagcgctttac

SEQ ID NO: 264 - RNA, 70 nt, Artificial Sequence
  RPS9 3'-UTR
guccaccugucccuccugggcugcuggauugucucguuuuccugccaaauaaacaggaucagcgcuuuac

SEQ ID NO: 265 - DNA, 187 bp, Artificial Sequence
  ALB7 3'-UTR
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 266 - RNA, 187 nt, Artificial Sequence
  ALB7 3'-UTR
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 267 - DNA, 44 bp, Artificial Sequence
  muag 3'-UTR
gcccgatgggcctcccaacgggccctcctcccctccttgcaccg

SEQ ID NO: 268 - RNA, 44 nt, Artificial Sequence
  muag 3'-UTR
gcccgaugggccucccaacgggcccuccuccccuccuugcaccg

SEQ ID NO: 269-2618 - skipped (2350 entries)

SEQ ID NO: 2619 - protein, 1147 aa, Artificial Sequence
  SARS-CoV-2/Wuhan/WIV05/2019__EPI_ISL_402128 spike protein (1-1147)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDS

SEQ ID NO: 2620-13175 - skipped (10556 entries)

SEQ ID NO: 13176 - protein, 126 aa, Artificial Sequence
  SARS-CoV-2/Wuhan/WIV05/2019__EPI_ISL_402128 spike protein (1148-1273)
FKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13177-13242 - skipped (66 entries)

SEQ ID NO: 13243 - protein, 223 aa, Artificial Sequence
  SARS-CoV-2/Wuhan/WIV05/2019__EPI_ISL_402128 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13244-13309 - skipped (66 entries)

SEQ ID NO: 13310 - protein, 201 aa, Artificial Sequence
  SARS-CoV-2/Wuhan/WIV05/2019__EPI_ISL_402128 spike protein (329-529)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKK

SEQ ID NO: 13311-22728 - skipped (9418 entries)

SEQ ID NO: 22729 - DNA, 23 bp, Artificial Sequence
  Primer 2019-nCoV_sgE-forward
cgatctcttgtagatctgttctc

SEQ ID NO: 22730 - DNA, 22 bp, Artificial Sequence
  Primer 2019-nCoV_sgE-reverse
atattgcagcagtacgcacaca

SEQ ID NO: 22731 - DNA, 26 bp, Artificial Sequence
  Primer 2019-nCoV_sgE-probe
acactagccatccttactgcgcttcg

SEQ ID NO: 22732-22737 - skipped (6 entries)

SEQ ID NO: 22738 - protein, 1273 aa, Artificial Sequence
  SARS-CoV-2/Wuhan/WIV05/2019__EPI_ISL_402128 spike protein (1-1273)(K986P_V987P_ D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22739 - skipped

SEQ ID NO: 22740 - protein, 1273 aa, Artificial Sequence
  SARS-CoV-2/Wuhan/WIV05/2019__EPI_ISL_402128 spike protein (1-1273)(K986P_V987P_A222V_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22741 - skipped

SEQ ID NO: 22742 - protein, 1273 aa, Artificial Sequence
  SARS-CoV-2/Wuhan/WIV05/2019__EPI_ISL_402128 spike protein (1-1273)(K986P_V987P_N439K_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSKNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22743 - skipped

SEQ ID NO: 22744 - protein, 1273 aa, Artificial Sequence
  SARS-CoV-2/Wuhan/WIV05/2019__EPI_ISL_402128 spike protein (1-1273)(K986P_V987P_S477N_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22745 - skipped

SEQ ID NO: 22746 - protein, 1273 aa, Artificial Sequence
  SARS-CoV-2/Wuhan/WIV05/2019__EPI_ISL_402128 spike protein (1-1273)(K986P_V987P_N501Y_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22747 - skipped

SEQ ID NO: 22748 - protein, 1271 aa, Artificial Sequence
  SARS-CoV-2/Wuhan/WIV05/2019__EPI_ISL_402128 spike protein (1-1273)(K986P_V987P_H69del_V70del_D614G)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22749 - skipped

SEQ ID NO: 22750 - protein, 1273 aa, Artificial Sequence
  SARS-CoV-2/Wuhan/WIV05/2019__EPI_ISL_402128 spike protein (1-1273)(K986P_V987P_Y453F_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22751 - skipped

SEQ ID NO: 22752 - protein, 1273 aa, Artificial Sequence
  SARS-CoV-2/Wuhan/WIV05/2019__EPI_ISL_402128 spike protein (1-1273)(K986P_V987P_D614G_I692V)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22753 - skipped

SEQ ID NO: 22754 - protein, 1273 aa, Artificial Sequence
  SARS-CoV-2/Wuhan/WIV05/2019__EPI_ISL_402128 spike protein (1-1273)(K986P_V987P_D614G_M1229I)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 22755 - skipped

SEQ ID NO: 22756 - protein, 1271 aa, Artificial Sequence
  SARS-CoV-2/Wuhan/WIV05/2019__EPI_ISL_402128 spike protein (1-1273)(K986P_V987P_H69del_V70del_A222V_Y453F_S477N_D614G_I692V)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22757 - skipped

SEQ ID NO: 22758 - protein, 1271 aa, Artificial Sequence
  SARS-CoV-2/Wuhan/WIV05/2019__EPI_ISL_402128 spike protein (1-1273)(K986P_V987P_H69del_V70del_Y453F_D614G_I692V_M1229I)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 22759-22764 - skipped (6 entries)

SEQ ID NO: 22765 - RNA, 3822 nt, Artificial Sequence
  SARS-CoV-2/Wuhan/WIV05/2019__EPI_ISL_402128 spike protein CDS gc (1-1273)(K986P_V987P_ D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22766 - skipped

SEQ ID NO: 22767 - RNA, 3822 nt, Artificial Sequence
  SARS-CoV-2/Wuhan/WIV05/2019__EPI_ISL_402128 spike protein CDS gc (1-1273)(K986P_V987P_A222V_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22768 - skipped

SEQ ID NO: 22769 - RNA, 3822 nt, Artificial Sequence
  SARS-CoV-2/Wuhan/WIV05/2019__EPI_ISL_402128 spike protein CDS gc (1-1273)(K986P_V987P_N439K_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22770 - skipped

SEQ ID NO: 22771 - RNA, 3822 nt, Artificial Sequence
  SARS-CoV-2/Wuhan/WIV05/2019__EPI_ISL_402128 spike protein CDS gc (1-1273)(K986P_V987P_S477N_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22772 - skipped

SEQ ID NO: 22773 - RNA, 3822 nt, Artificial Sequence
  SARS-CoV-2/Wuhan/WIV05/2019__EPI_ISL_402128 spike protein CDS gc (1-1273)(K986P_V987P_N501Y_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22774 - skipped

SEQ ID NO: 22775 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22776 - skipped

SEQ ID NO: 22777 - RNA, 3822 nt, Artificial Sequence
  SARS-CoV-2/Wuhan/WIV05/2019__EPI_ISL_402128 spike protein CDS gc (1-1273)(K986P_V987P_Y453F_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22778 - skipped

SEQ ID NO: 22779 - RNA, 3822 nt, Artificial Sequence
  SARS-CoV-2/Wuhan/WIV05/2019__EPI_ISL_402128 spike protein CDS gc (1-1273)(K986P_V987P_D614G_I692V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22780 - skipped

SEQ ID NO: 22781 - RNA, 3822 nt, Artificial Sequence
  SARS-CoV-2/Wuhan/WIV05/2019__EPI_ISL_402128 spike protein CDS gc (1-1273)(K986P_V987P_D614G_M1229I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22782 - skipped

SEQ ID NO: 22783 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_A222V_Y453F_S477N_D614G_I692V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22784 - skipped

SEQ ID NO: 22785 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_Y453F_D614G_I692V_M1229I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 22786-22791 - skipped (6 entries)

SEQ ID NO: 22792 - RNA, 4094 nt, Artificial Sequence
  SARS-CoV-2/Wuhan/WIV05/2019__EPI_ISL_402128 spike protein mRNA gc (1-1273)(K986P_V987P_ D614G) R10166
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22793 - skipped

SEQ ID NO: 22794 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G) R10279
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22795 - skipped

SEQ ID NO: 22796 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G) R10299
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22797 - skipped

SEQ ID NO: 22798 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G) R10286
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22799 - skipped

SEQ ID NO: 22800 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22801 - skipped

SEQ ID NO: 22802 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G) R10275
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22803 - skipped

SEQ ID NO: 22804 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G) R10283
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22805 - skipped

SEQ ID NO: 22806 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V) R10291
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22807 - skipped

SEQ ID NO: 22808 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22809 - skipped

SEQ ID NO: 22810 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V) R10295
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22811 - skipped

SEQ ID NO: 22812 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22813-22818 - skipped (6 entries)

SEQ ID NO: 22819 - RNA, 4039 nt, Artificial Sequence
  SARS-CoV-2/Wuhan/WIV05/2019__EPI_ISL_402128 spike protein mRNA gc (1-1273)(K986P_V987P_ D614G) R10165
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22820 - skipped

SEQ ID NO: 22821 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G) R10277
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22822 - skipped

SEQ ID NO: 22823 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G) R10297
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22824 - skipped

SEQ ID NO: 22825 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G) R10285
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22826 - skipped

SEQ ID NO: 22827 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G) R10351
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22828 - skipped

SEQ ID NO: 22829 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G) R10273
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22830 - skipped

SEQ ID NO: 22831 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G) R10281
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22832 - skipped

SEQ ID NO: 22833 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V) R10289
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22834 - skipped

SEQ ID NO: 22835 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I) R10345
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22836 - skipped

SEQ ID NO: 22837 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V) R10293
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22838 - skipped

SEQ ID NO: 22839 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I) R10347
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 22840 - RNA, 6 nt, Artificial Sequence
  mRNA 5'-end
gggaaa

SEQ ID NO: 22841 - RNA, 6 nt, Artificial Sequence
  mRNA 5'-end
agaaua

SEQ ID NO: 22842 - RNA, 6 nt, Artificial Sequence
  mRNA 5'-end
agauua

SEQ ID NO: 22843 - RNA, 6 nt, Artificial Sequence
  mRNA 5'-end
gauggg

SEQ ID NO: 22844 - RNA, 5 nt, Artificial Sequence
  mRNA 5'-end
gggcg

SEQ ID NO: 22845 - RNA, 3 nt, Artificial Sequence
  Kozak sequence
acc

SEQ ID NO: 22846 - RNA, 9 nt, Artificial Sequence
  Kozak sequence
gccgccacc

SEQ ID NO: 22847 - RNA, 6 nt, Artificial Sequence
  Kozak sequence
gccacc

SEQ ID NO: 22848 - DNA, 57 bp, Artificial Sequence
  synthetic-v1 5'-UTR
gggaaataagagagaaaagaagagtaagaagaaatataagaccccggcgccgccacc

SEQ ID NO: 22849 - RNA, 57 nt, Artificial Sequence
  synthetic-v1 5'-UTR
gggaaauaagagagaaaagaagaguaagaagaaauauaagaccccggcgccgccacc

SEQ ID NO: 22850 - DNA, 57 bp, Artificial Sequence
  synthetic-v2 5'-UTR
aggagataagagagaaaagaagagtaagaagaaatataagaccccggcgccgccacc

SEQ ID NO: 22851 - RNA, 57 nt, Artificial Sequence
  synthetic-v2 5'-UTR
aggagauaagagagaaaagaagaguaagaagaaauauaagaccccggcgccgccacc

SEQ ID NO: 22852 - DNA, 47 bp, Artificial Sequence
  synthetic-v3 5'-UTR
gggaaataagagagaaaagaagagtaagaagaaatataagagccacc

SEQ ID NO: 22853 - RNA, 47 nt, Artificial Sequence
  synthetic-v3 5'-UTR
gggaaauaagagagaaaagaagaguaagaagaaauauaagagccacc

SEQ ID NO: 22854 - DNA, 47 bp, Artificial Sequence
  synthetic-v4 5'-UTR
aggagataagagagaaaagaagagtaagaagaaatataagagccacc

SEQ ID NO: 22855 - RNA, 47 nt, Artificial Sequence
  synthetic-v4 5'-UTR
aggagauaagagagaaaagaagaguaagaagaaauauaagagccacc

SEQ ID NO: 22856 - DNA, 53 bp, Artificial Sequence
  HBA1-v1 5'-UTR
agaataaactagtattcttctggtccccacagactcagagagaacccgccacc

SEQ ID NO: 22857 - RNA, 53 nt, Artificial Sequence
  HBA1-v1 5'-UTR
agaauaaacuaguauucuucugguccccacagacucagagagaacccgccacc

SEQ ID NO: 22858 - DNA, 56 bp, Artificial Sequence
  HBA1-v2 5'-UTR
aggagaataaactagtattcttctggtccccacagactcagagagaacccgccacc

SEQ ID NO: 22859 - RNA, 56 nt, Artificial Sequence
  HBA1-v2 5'-UTR
aggagaauaaacuaguauucuucugguccccacagacucagagagaacccgccacc

SEQ ID NO: 22860 - DNA, 53 bp, Artificial Sequence
  HBA1-v3 5'-UTR
aggagaaactagtattcttctggtccccacagactcagagagaacccgccacc

SEQ ID NO: 22861 - RNA, 53 nt, Artificial Sequence
  HBA1-v3 5'-UTR
aggagaaacuaguauucuucugguccccacagacucagagagaacccgccacc

SEQ ID NO: 22862 - DNA, 53 bp, Artificial Sequence
  HBA1-v4 5'-UTR
agattaaactagtattcttctggtccccacagactcagagagaacccgccacc

SEQ ID NO: 22863 - RNA, 53 nt, Artificial Sequence
  HBA1-v4 5'-UTR
agauuaaacuaguauucuucugguccccacagacucagagagaacccgccacc

SEQ ID NO: 22864 - DNA, 52 bp, Artificial Sequence
  HBA1-v5 5'-UTR
agacgaactagtattcttctggtccccacagactcagagagaacccgccacc

SEQ ID NO: 22865 - RNA, 52 nt, Artificial Sequence
  HBA1-v5 5'-UTR
agacgaacuaguauucuucugguccccacagacucagagagaacccgccacc

SEQ ID NO: 22866 - DNA, 52 bp, Artificial Sequence
  HBA1-v6 5'-UTR
gggcgaactagtattcttctggtccccacagactcagagagaacccgccacc

SEQ ID NO: 22867 - RNA, 52 nt, Artificial Sequence
  HBA1-v6 5'-UTR
gggcgaacuaguauucuucugguccccacagacucagagagaacccgccacc

SEQ ID NO: 22868 - DNA, 15 bp, Artificial Sequence
  minimal 5'-UTR
aggagaaagcttacc

SEQ ID NO: 22869 - RNA, 15 nt, Artificial Sequence
  minimal 5'-UTR
aggagaaagcuuacc

SEQ ID NO: 22870 - DNA, 77 bp, Artificial Sequence
  HSD17B4-v2 5'-UTR
aggagagtcccgcagtcggcgtccagcggctctgcttgttcgtgtgtgtgtcgttgcaggccttattcaagcttacc

SEQ ID NO: 22871 - RNA, 77 nt, Artificial Sequence
  HSD17B4-v2 5'-UTR
aggagagucccgcagucggcguccagcggcucugcuuguucgugugugugucguugcaggccuuauucaagcuuacc

SEQ ID NO: 22872 - DNA, 99 bp, Artificial Sequence
  Rpl31-v2 5'-UTR
aggagacccgtgacccggaagttgtacggctacgcgactttccctcccacaaaccctcgcgcccttcctttcctacttgggcccggcagaaagcttacc

SEQ ID NO: 22873 - RNA, 99 nt, Artificial Sequence
  Rpl31-v2 5'-UTR
aggagacccgugacccggaaguuguacggcuacgcgacuuucccucccacaaacccucgcgcccuuccuuuccuacuugggcccggcagaaagcuuacc

SEQ ID NO: 22874 - DNA, 174 bp, Artificial Sequence
  Slc7a3-v2 5'-UTR
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttacc

SEQ ID NO: 22875 - RNA, 174 nt, Artificial Sequence
  Slc7a3-v2 5'-UTR
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuacc

SEQ ID NO: 22876 - DNA, 110 bp, Artificial Sequence
  HBA1-v1 3'-UTR
gctggagcctcggtggccatgcttcttgccccttgggcctccccccagcccctcctccccttcctgcacccgtacccccgtggtctttgaataaagtctgagtgggcggc

SEQ ID NO: 22877 - RNA, 110 nt, Artificial Sequence
  HBA1-v1 3'-UTR
gcuggagccucgguggccaugcuucuugccccuugggccuccccccagccccuccuccccuuccugcacccguacccccguggucuuugaauaaagucugagugggcggc

SEQ ID NO: 22878 - DNA, 108 bp, Artificial Sequence
  HBA2 3'-UTR
gctggagcctcggtagccgttcctcctgcccgctgggcctcccaacgggccctcctcccctccttgcaccggcccttcctggtctttgaataaagtctgagtgggcag

SEQ ID NO: 22879 - RNA, 108 nt, Artificial Sequence
  HBA2 3'-UTR
gcuggagccucgguagccguuccuccugcccgcugggccucccaacgggcccuccuccccuccuugcaccggcccuuccuggucuuugaauaaagucugagugggcag

SEQ ID NO: 22880 - DNA, 132 bp, Artificial Sequence
  HBB-v1 3'-UTR
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 22881 - RNA, 132 nt, Artificial Sequence
  HBB-v1 3'-UTR
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 22882 - DNA, 119 bp, Artificial Sequence
  HBA1-v2 3'-UTR
tgataataggctggagcctcggtggcctagcttcttgccccttgggcctccccccagcccctcctccccttcctgcacccgtacccccgtggtctttgaataaagtctgagtgggcggc

SEQ ID NO: 22883 - RNA, 119 nt, Artificial Sequence
  HBA1-v2 3'-UTR
ugauaauaggcuggagccucgguggccuagcuucuugccccuugggccuccccccagccccuccuccccuuccugcacccguacccccguggucuuugaauaaagucugagugggcggc

SEQ ID NO: 22884 - DNA, 119 bp, Artificial Sequence
  HBA1-v3 3'-UTR
tgataataggctggagcctcggtggccatgcttcttgccccttgggcctccccccagcccctcctccccttcctgcacccgtacccccgtggtctttgaataaagtctgagtgggcggc

SEQ ID NO: 22885 - RNA, 119 nt, Artificial Sequence
  HBA1-v33'-UTR
ugauaauaggcuggagccucgguggccaugcuucuugccccuugggccuccccccagccccuccuccccuuccugcacccguacccccguggucuuugaauaaagucugagugggcggc

SEQ ID NO: 22886 - DNA, 295 bp, Artificial Sequence
  AES-12S-v1 3'-UTR
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagc

SEQ ID NO: 22887 - RNA, 295 nt, Artificial Sequence
  AES-12S-v1 3'-UTR
cucgagcugguacugcaugcacgcaaugcuagcugccccuuucccguccuggguaccccgagucucccccgaccucgggucccagguaugcucccaccuccaccugccccacucaccaccucugcuaguuccagacaccucccaagcacgcagcaaugcagcucaaaacgcuuagccuagccacacccccacgggaaacagcagugauuaaccuuuagcaauaaacgaaaguuuaacuaagcuauacuaaccccaggguuggucaauuucgugccagccacacccuggagcuagc

SEQ ID NO: 22888 - DNA, 317 bp, Artificial Sequence
  AES-12S-v2 3'-UTR
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccgagacctggtccagagtcgctagccgcgtcgct

SEQ ID NO: 22889 - RNA, 317 nt, Artificial Sequence
  AES-12S-v2 3'-UTR
cucgagcugguacugcaugcacgcaaugcuagcugccccuuucccguccuggguaccccgagucucccccgaccucgggucccagguaugcucccaccuccaccugccccacucaccaccucugcuaguuccagacaccucccaagcacgcagcaaugcagcucaaaacgcuuagccuagccacacccccacgggaaacagcagugauuaaccuuuagcaauaaacgaaaguuuaacuaagcuauacuaaccccaggguuggucaauuucgugccagccacaccgagaccugguccagagucgcuagccgcgucgcu

SEQ ID NO: 22890 - DNA, 311 bp, Artificial Sequence
  HBB-v2 3'-UTR
ctcgagagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcgtcgagacctggtccagagtcgctagc

SEQ ID NO: 22891 - RNA, 311 nt, Artificial Sequence
  HBB-v2 3'-UTR
cucgagagcucgcuuucuugcuguccaauuucuauuaaagguuccuuuguucccuaaguccaacuacuaaacugggggauauuaugaagggccuugagcaucuggauucugccuaauaaaaaacauuuauuuucauugcugcgucgagagcucgcuuucuugcuguccaauuucuauuaaagguuccuuuguucccuaaguccaacuacuaaacugggggauauuaugaagggccuugagcaucuggauucugccuaauaaaaaacauuuauuuucauugcugcgucgagaccugguccagagucgcuagc

SEQ ID NO: 22892 - DNA, 95 bp, Artificial Sequence
  PSMB3-v2 3'-UTR
ggactagtccctgttcccagagcccacttttttttctttttttgaaataaaatagcctgtctttcagatctcaaaggctcttttcagagccacca

SEQ ID NO: 22893 - RNA, 95 nt, Artificial Sequence
  PSMB3-v2 3'-UTR
ggacuagucccuguucccagagcccacuuuuuuuucuuuuuuugaaauaaaauagccugucuuucagaucucaaaggcucuuuucagagccacca

SEQ ID NO: 22894 - DNA, 108 bp, Artificial Sequence
  RPS9-v2 3'-UTR
ggactagtgtccacctgtccctcctgggctgctggattgtctcgttttcctgccaaataaacaggatcagcgctttacagatctcaaaggctcttttcagagccacca

SEQ ID NO: 22895 - RNA, 108 nt, Artificial Sequence
  RPS9-v2 3'-UTR
ggacuaguguccaccugucccuccugggcugcuggauugucucguuuuccugccaaauaaacaggaucagcgcuuuacagaucucaaaggcucuuuucagagccacca

SEQ ID NO: 22896 - DNA, 98 bp, Artificial Sequence
  muag-v2 3'-UTR
ggactagttataagactgactagcccgatgggcctcccaacgggccctcctcccctccttgcaccgagattaatcaaaggctcttttcagagccacca

SEQ ID NO: 22897 - RNA, 98 nt, Artificial Sequence
  muag-v2 3'-UTR
ggacuaguuauaagacugacuagcccgaugggccucccaacgggcccuccuccccuccuugcaccgagauuaaucaaaggcucuuuucagagccacca

SEQ ID NO: 22898 - DNA, 104 bp, Artificial Sequence
  muag-v2 3'-UTR
ggactagttataagactgactagcccgatgggcctcccaacgggccctcctcccctccttgcaccgagattaatagatctcaaaggctcttttcagagccacca

SEQ ID NO: 22899 - RNA, 104 nt, Artificial Sequence
  muag-v2 3'-UTR
ggacuaguuauaagacugacuagcccgaugggccucccaacgggcccuccuccccuccuugcaccgagauuaauagaucucaaaggcucuuuucagagccacca

SEQ ID NO: 22900 - DNA, 98 bp, Artificial Sequence
  muag-v2 3'-UTR
ggactagttataagactgactagcccgatgggcctcccaacgggccctcctcccctccttgcaccgagagatctcaaaggctcttttcagagccacca

SEQ ID NO: 22901 - RNA, 98 nt, Artificial Sequence
  muag-v2 3'-UTR
ggacuaguuauaagacugacuagcccgaugggccucccaacgggcccuccuccccuccuugcaccgagagaucucaaaggcucuuuucagagccacca

SEQ ID NO: 22902 - DNA, 71 bp, Artificial Sequence
  PSMB3-v2 3'-UTR
ggactagtccctgttcccagagcccacttttttttctttttttgaaataaaatagcctgtctttcagatct

SEQ ID NO: 22903 - RNA, 71 nt, Artificial Sequence
  PSMB3-v2 3'-UTR
ggacuagucccuguucccagagcccacuuuuuuuucuuuuuuugaaauaaaauagccugucuuucagaucu

SEQ ID NO: 22904 - DNA, 84 bp, Artificial Sequence
  RPS9-v2 3'-UTR
ggactagtgtccacctgtccctcctgggctgctggattgtctcgttttcctgccaaataaacaggatcagcgctttacagatct

SEQ ID NO: 22905 - RNA, 84 nt, Artificial Sequence
  RPS9-v2 3'-UTR
ggacuaguguccaccugucccuccugggcugcuggauugucucguuuuccugccaaauaaacaggaucagcgcuuuacagaucu

SEQ ID NO: 22906 - DNA, 74 bp, Artificial Sequence
  muag-v2 3'-UTR
ggactagttataagactgactagcccgatgggcctcccaacgggccctcctcccctccttgcaccgagattaat

SEQ ID NO: 22907 - RNA, 74 nt, Artificial Sequence
  muag-v2 3'-UTR
ggacuaguuauaagacugacuagcccgaugggccucccaacgggcccuccuccccuccuugcaccgagauuaau

SEQ ID NO: 22908 - DNA, 80 bp, Artificial Sequence
  muag-v2 3'-UTR
ggactagttataagactgactagcccgatgggcctcccaacgggccctcctcccctccttgcaccgagattaatagatct

SEQ ID NO: 22909 - RNA, 80 nt, Artificial Sequence
  muag-v2 3'-UTR
ggacuaguuauaagacugacuagcccgaugggccucccaacgggcccuccuccccuccuugcaccgagauuaauagaucu

SEQ ID NO: 22910 - DNA, 74 bp, Artificial Sequence
  muag-v2 3'-UTR
ggactagttataagactgactagcccgatgggcctcccaacgggccctcctcccctccttgcaccgagagatct

SEQ ID NO: 22911 - RNA, 74 nt, Artificial Sequence
  muag-v2 3'-UTR
ggacuaguuauaagacugacuagcccgaugggccucccaacgggcccuccuccccuccuugcaccgagagaucu

SEQ ID NO: 22912 - RNA, 105 nt, Artificial Sequence
  mRNA 3'-end A100-N5
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 22913 - RNA, 110 nt, Artificial Sequence
  mRNA 3'-end A30-N10-A70
aaaaaaaaaaaaaaaaaaaaaaaaaaaaaagcauaugacuaaaaaaaaaaaaaaaaaaaaaaaaaaaaaaaaaaaaaaaaaaaaaaaaaaaaaaaaaaaaaaaaaaaaaa

SEQ ID NO: 22914-22916 - skipped (3 entries)

SEQ ID NO: 22917 - protein, 195 aa, Artificial Sequence
  SARS-CoV-2/Wuhan/WIV05/2019__EPI_ISL_402128 spike protein (334-528)
NLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPK

SEQ ID NO: 22918-22922 - skipped (5 entries)

SEQ ID NO: 22923 - protein, 202 aa, Artificial Sequence
  SARS-CoV-2/Wuhan/WIV05/2019__EPI_ISL_402128 spike protein (327-528)
VRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPK

SEQ ID NO: 22924-22958 - skipped (35 entries)

SEQ ID NO: 22959 - protein, 1270 aa, Artificial Sequence
  SARS-CoV-2/Wuhan/WIV05/2019__EPI_ISL_402128 spike protein (1-1273)(K986P_V987P_K986P_V987P_H69del_V70del_Y144del_N501Y_A570 D_D614G_P681H_T716I_S982A_D1118H)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22960 - protein, 1273 aa, Artificial Sequence
  SARS-CoV-2/Wuhan/WIV05/2019__EPI_ISL_402128 spike protein (1-1273)(K986P_V987P_K986P_V987P_K417N_E484K_N501Y_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22961 - protein, 1270 aa, Artificial Sequence
  SARS-CoV-2/Wuhan/WIV05/2019__EPI_ISL_402128 spike protein (1-1273)(K986P_V987P_K986P_V987P_L18F_D80A_D215G_L242del_A243del_ L244del_R246I_K417N_E484K_N501Y_D614G_A701V)
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHISYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22962 - protein, 1273 aa, Artificial Sequence
  SARS-CoV-2/Wuhan/WIV05/2019__EPI_ISL_402128 spike protein (1-1273)(K986P_V987P_K986P_V987P_E484K_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22963 - protein, 1273 aa, Artificial Sequence
  SARS-CoV-2/Wuhan/WIV05/2019__EPI_ISL_402128 spike protein (1-1273)(K986P_V987P_K986P_V987P_L18F_T20N_P26S_D138Y_R190S_K417T _E484K_N501Y_D614G_H655Y_T1027I)
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22964 - protein, 1273 aa, Artificial Sequence
  SARS-CoV-2/Wuhan/WIV05/2019__EPI_ISL_402128 spike protein (1-1273)(K986P_V987P_K986P_V987P_S13I_W152C_L452R_D614G)
MFVFLVLLPLVSIQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22965-23088 - skipped (124 entries)

SEQ ID NO: 23089 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_H69del_V70del_Y144del_N501Y_A570 D_D614G_P681H_T716I_S982A_D1118H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 23090 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_K417N_E484K_N501Y_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 23091 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_L18F_D80A_D215G_L242del_A243del_ L244del_R246I_K417N_E484K_N501Y_D614G_A701V)
auguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 23092 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_E484K_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 23093 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_L18F_T20N_P26S_D138Y_R190S_K417T _E484K_N501Y_D614G_H655Y_T1027I)
auguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 23094 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_S13I_W152C_L452R_D614G)
auguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 23095 - RNA, 3822 nt, Artificial Sequence
  SARS-CoV-2/Wuhan/WIV05/2019__EPI_ISL_402128 spike protein CDS gc (1-1273)(K986P_V987P)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacguga

SEQ ID NO: 23096 - RNA, 3822 nt, Artificial Sequence
  SARS-CoV-2/Wuhan/WIV05/2019__EPI_ISL_402128 spike protein CDS gc (1-1273)(K986P_V987P_ D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23097 - RNA, 3822 nt, Artificial Sequence
  SARS-CoV-2/Wuhan/WIV05/2019__EPI_ISL_402128 spike protein CDS gc (1-1273)(K986P_V987P_A222V_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacguga

SEQ ID NO: 23098 - RNA, 3822 nt, Artificial Sequence
  SARS-CoV-2/Wuhan/WIV05/2019__EPI_ISL_402128 spike protein CDS gc (1-1273)(K986P_V987P_N439K_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23099 - RNA, 3822 nt, Artificial Sequence
  SARS-CoV-2/Wuhan/WIV05/2019__EPI_ISL_402128 spike protein CDS gc (1-1273)(K986P_V987P_S477N_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacguga

SEQ ID NO: 23100 - RNA, 3822 nt, Artificial Sequence
  SARS-CoV-2/Wuhan/WIV05/2019__EPI_ISL_402128 spike protein CDS gc (1-1273)(K986P_V987P_N501Y_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23101 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacguga

SEQ ID NO: 23102 - RNA, 3822 nt, Artificial Sequence
  SARS-CoV-2/Wuhan/WIV05/2019__EPI_ISL_402128 spike protein CDS gc (1-1273)(K986P_V987P_Y453F_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23103 - RNA, 3822 nt, Artificial Sequence
  SARS-CoV-2/Wuhan/WIV05/2019__EPI_ISL_402128 spike protein CDS gc (1-1273)(K986P_V987P_D614G_I692V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacguga

SEQ ID NO: 23104 - RNA, 3822 nt, Artificial Sequence
  SARS-CoV-2/Wuhan/WIV05/2019__EPI_ISL_402128 spike protein CDS gc (1-1273)(K986P_V987P_D614G_M1229I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23105 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_A222V_Y453F_S477N_D614G_I692V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacguga

SEQ ID NO: 23106 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_Y453F_D614G_I692V_M1229I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23107 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_H69del_V70del_Y144del_N501Y_A570 D_D614G_P681H_T716I_S982A_D1118H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccuga

SEQ ID NO: 23108 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_K417N_E484K_N501Y_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23109 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_L18F_D80A_D215G_L242del_A243del_ L244del_R246I_K417N_E484K_N501Y_D614G_A701V)
auguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacguga

SEQ ID NO: 23110 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_E484K_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 23111 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_L18F_T20N_P26S_D138Y_R190S_K417T _E484K_N501Y_D614G_H655Y_T1027I)
auguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccuga

SEQ ID NO: 23112 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_S13I_W152C_L452R_D614G)
auguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacguga

SEQ ID NO: 23113 - RNA, 3822 nt, Artificial Sequence
  SARS-CoV-2/Wuhan/WIV05/2019__EPI_ISL_402128 spike protein CDS gc (1-1273)(K986P_V987P)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23114 - RNA, 3822 nt, Artificial Sequence
  SARS-CoV-2/Wuhan/WIV05/2019__EPI_ISL_402128 spike protein CDS gc (1-1273)(K986P_V987P_ D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23115 - RNA, 3822 nt, Artificial Sequence
  SARS-CoV-2/Wuhan/WIV05/2019__EPI_ISL_402128 spike protein CDS gc (1-1273)(K986P_V987P_A222V_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23116 - RNA, 3822 nt, Artificial Sequence
  SARS-CoV-2/Wuhan/WIV05/2019__EPI_ISL_402128 spike protein CDS gc (1-1273)(K986P_V987P_N439K_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23117 - RNA, 3822 nt, Artificial Sequence
  SARS-CoV-2/Wuhan/WIV05/2019__EPI_ISL_402128 spike protein CDS gc (1-1273)(K986P_V987P_S477N_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23118 - RNA, 3822 nt, Artificial Sequence
  SARS-CoV-2/Wuhan/WIV05/2019__EPI_ISL_402128 spike protein CDS gc (1-1273)(K986P_V987P_N501Y_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23119 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23120 - RNA, 3822 nt, Artificial Sequence
  SARS-CoV-2/Wuhan/WIV05/2019__EPI_ISL_402128 spike protein CDS gc (1-1273)(K986P_V987P_Y453F_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23121 - RNA, 3822 nt, Artificial Sequence
  SARS-CoV-2/Wuhan/WIV05/2019__EPI_ISL_402128 spike protein CDS gc (1-1273)(K986P_V987P_D614G_I692V)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23122 - RNA, 3822 nt, Artificial Sequence
  SARS-CoV-2/Wuhan/WIV05/2019__EPI_ISL_402128 spike protein CDS gc (1-1273)(K986P_V987P_D614G_M1229I)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23123 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_A222V_Y453F_S477N_D614G_I692V)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23124 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_Y453F_D614G_I692V_M1229I)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23125 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_H69del_V70del_Y144del_N501Y_A570 D_D614G_P681H_T716I_S982A_D1118H)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23126 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_K417N_E484K_N501Y_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23127 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_L18F_D80A_D215G_L242del_A243del_ L244del_R246I_K417N_E484K_N501Y_D614G_A701V)
auguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23128 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_E484K_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23129 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_L18F_T20N_P26S_D138Y_R190S_K417T _E484K_N501Y_D614G_H655Y_T1027I)
auguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23130 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_S13I_W152C_L452R_D614G)
auguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 23131 - RNA, 3822 nt, Artificial Sequence
  SARS-CoV-2/Wuhan/WIV05/2019__EPI_ISL_402128 spike protein CDS gc (1-1273)(K986P_V987P)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23132 - RNA, 3822 nt, Artificial Sequence
  SARS-CoV-2/Wuhan/WIV05/2019__EPI_ISL_402128 spike protein CDS gc (1-1273)(K986P_V987P_ D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23133 - RNA, 3822 nt, Artificial Sequence
  SARS-CoV-2/Wuhan/WIV05/2019__EPI_ISL_402128 spike protein CDS gc (1-1273)(K986P_V987P_A222V_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23134 - RNA, 3822 nt, Artificial Sequence
  SARS-CoV-2/Wuhan/WIV05/2019__EPI_ISL_402128 spike protein CDS gc (1-1273)(K986P_V987P_N439K_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23135 - RNA, 3822 nt, Artificial Sequence
  SARS-CoV-2/Wuhan/WIV05/2019__EPI_ISL_402128 spike protein CDS gc (1-1273)(K986P_V987P_S477N_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23136 - RNA, 3822 nt, Artificial Sequence
  SARS-CoV-2/Wuhan/WIV05/2019__EPI_ISL_402128 spike protein CDS gc (1-1273)(K986P_V987P_N501Y_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23137 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23138 - RNA, 3822 nt, Artificial Sequence
  SARS-CoV-2/Wuhan/WIV05/2019__EPI_ISL_402128 spike protein CDS gc (1-1273)(K986P_V987P_Y453F_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23139 - RNA, 3822 nt, Artificial Sequence
  SARS-CoV-2/Wuhan/WIV05/2019__EPI_ISL_402128 spike protein CDS gc (1-1273)(K986P_V987P_D614G_I692V)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23140 - RNA, 3822 nt, Artificial Sequence
  SARS-CoV-2/Wuhan/WIV05/2019__EPI_ISL_402128 spike protein CDS gc (1-1273)(K986P_V987P_D614G_M1229I)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23141 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_A222V_Y453F_S477N_D614G_I692V)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23142 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_Y453F_D614G_I692V_M1229I)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23143 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_H69del_V70del_Y144del_N501Y_A570 D_D614G_P681H_T716I_S982A_D1118H)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23144 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_K417N_E484K_N501Y_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23145 - RNA, 3813 nt, Artificial Sequence
  SARS-CoV-2/Wuhan/WIV05/2019__EPI_ISL_402128 spike protein CDS gc (1-1273)(K986P_V987P_K986P_V987P_L18F_D80A_D215G_L242del_A243del_ L244del_R246I_K417N_E484K_N501Y_D614G_A701V)
auguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23146 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_E484K_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23147 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_L18F_T20N_P26S_D138Y_R190S_K417T _E484K_N501Y_D614G_H655Y_T1027I)
auguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuga

SEQ ID NO: 23148 - RNA, 3822 nt, Artificial Sequence
  SARS-CoV-2/Wuhan/WIV05/2019__EPI_ISL_402128 spike protein CDS gc (1-1273)(K986P_V987P_K986P_V987P_S13I_W152C_L452R_D614G)
auguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccuga

SEQ ID NO: 23149 - skipped

SEQ ID NO: 23150 - RNA, 3822 nt, Artificial Sequence
  SARS-CoV-2/Wuhan/WIV05/2019__EPI_ISL_402128 spike protein CDS gc mod (1-1273)(K986P_V987P_ D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23151 - RNA, 3822 nt, Artificial Sequence
  SARS-CoV-2/Wuhan/WIV05/2019__EPI_ISL_402128 spike protein CDS gc mod (1-1273)(K986P_V987P_A222V_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23152 - RNA, 3822 nt, Artificial Sequence
  SARS-CoV-2/Wuhan/WIV05/2019__EPI_ISL_402128 spike protein CDS gc mod (1-1273)(K986P_V987P_N439K_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23153 - RNA, 3822 nt, Artificial Sequence
  SARS-CoV-2/Wuhan/WIV05/2019__EPI_ISL_402128 spike protein CDS gc mod (1-1273)(K986P_V987P_S477N_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23154 - RNA, 3822 nt, Artificial Sequence
  SARS-CoV-2/Wuhan/WIV05/2019__EPI_ISL_402128 spike protein CDS gc mod (1-1273)(K986P_V987P_N501Y_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23155 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23156 - RNA, 3822 nt, Artificial Sequence
  SARS-CoV-2/Wuhan/WIV05/2019__EPI_ISL_402128 spike protein CDS gc mod (1-1273)(K986P_V987P_Y453F_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23157 - RNA, 3822 nt, Artificial Sequence
  SARS-CoV-2/Wuhan/WIV05/2019__EPI_ISL_402128 spike protein CDS gc mod (1-1273)(K986P_V987P_D614G_I692V)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23158 - RNA, 3822 nt, Artificial Sequence
  SARS-CoV-2/Wuhan/WIV05/2019__EPI_ISL_402128 spike protein CDS gc mod (1-1273)(K986P_V987P_D614G_M1229I)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23159 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_A222V_Y453F_S477N_D614G_I692V)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23160 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_Y453F_D614G_I692V_M1229I)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23161 - RNA, 3813 nt, Artificial Sequence
  SARS-CoV-2/Wuhan/WIV05/2019__EPI_ISL_402128 spike protein CDS gc mod (1-1273)(K986P_V987P_K986P_V987P_H69del_V70del_Y144del_N501Y_A570 D_D614G_P681H_T716I_S982A_D1118H)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23162 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_K417N_E484K_N501Y_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23163 - RNA, 3813 nt, Artificial Sequence
  SARS-CoV-2/Wuhan/WIV05/2019__EPI_ISL_402128 spike protein CDS gc mod (1-1273)(K986P_V987P_K986P_V987P_L18F_D80A_D215G_L242del_A243del_ L244del_R246I_K417N_E484K_N501Y_D614G_A701V)
auguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23164 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_E484K_D614G)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23165 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_L18F_T20N_P26S_D138Y_R190S_K417T _E484K_N501Y_D614G_H655Y_T1027I)
auguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23166 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_S13I_W152C_L452R_D614G)
auguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 23167 - RNA, 3822 nt, Artificial Sequence
  SARS-CoV-2/Wuhan/WIV05/2019__EPI_ISL_402128 spike protein CDS gc mod (1-1273)(K986P_V987P)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23168 - RNA, 3822 nt, Artificial Sequence
  SARS-CoV-2/Wuhan/WIV05/2019__EPI_ISL_402128 spike protein CDS gc mod (1-1273)(K986P_V987P_ D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23169 - RNA, 3822 nt, Artificial Sequence
  SARS-CoV-2/Wuhan/WIV05/2019__EPI_ISL_402128 spike protein CDS gc mod (1-1273)(K986P_V987P_A222V_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23170 - RNA, 3822 nt, Artificial Sequence
  SARS-CoV-2/Wuhan/WIV05/2019__EPI_ISL_402128 spike protein CDS gc mod (1-1273)(K986P_V987P_N439K_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23171 - RNA, 3822 nt, Artificial Sequence
  SARS-CoV-2/Wuhan/WIV05/2019__EPI_ISL_402128 spike protein CDS gc mod (1-1273)(K986P_V987P_S477N_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23172 - RNA, 3822 nt, Artificial Sequence
  SARS-CoV-2/Wuhan/WIV05/2019__EPI_ISL_402128 spike protein CDS gc mod (1-1273)(K986P_V987P_N501Y_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23173 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23174 - RNA, 3822 nt, Artificial Sequence
  SARS-CoV-2/Wuhan/WIV05/2019__EPI_ISL_402128 spike protein CDS gc mod (1-1273)(K986P_V987P_Y453F_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23175 - RNA, 3822 nt, Artificial Sequence
  SARS-CoV-2/Wuhan/WIV05/2019__EPI_ISL_402128 spike protein CDS gc mod (1-1273)(K986P_V987P_D614G_I692V)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23176 - RNA, 3822 nt, Artificial Sequence
  SARS-CoV-2/Wuhan/WIV05/2019__EPI_ISL_402128 spike protein CDS gc mod (1-1273)(K986P_V987P_D614G_M1229I)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23177 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_A222V_Y453F_S477N_D614G_I692V)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23178 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_Y453F_D614G_I692V_M1229I)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23179 - RNA, 3813 nt, Artificial Sequence
  SARS-CoV-2/Wuhan/WIV05/2019__EPI_ISL_402128 spike protein CDS gc mod (1-1273)(K986P_V987P_K986P_V987P_H69del_V70del_Y144del_N501Y_A570 D_D614G_P681H_T716I_S982A_D1118H)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23180 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_K417N_E484K_N501Y_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23181 - RNA, 3813 nt, Artificial Sequence
  SARS-CoV-2/Wuhan/WIV05/2019__EPI_ISL_402128 spike protein CDS gc mod (1-1273)(K986P_V987P_K986P_V987P_L18F_D80A_D215G_L242del_A243del_ L244del_R246I_K417N_E484K_N501Y_D614G_A701V)
auguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23182 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_E484K_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23183 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_L18F_T20N_P26S_D138Y_R190S_K417T _E484K_N501Y_D614G_H655Y_T1027I)
auguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23184 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_S13I_W152C_L452R_D614G)
auguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23185-23308 - skipped (124 entries)

SEQ ID NO: 23309 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H) R10353
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23310 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G) R10360
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23311 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V) R10379
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23312 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G) R10378
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23313 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I) R10380
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23314 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G) R10381
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23315 - RNA, 4039 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23316 - RNA, 4039 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23317 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23318 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23319 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23320 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23321 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23322 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23323 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23324 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23325 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23326 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23327 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23328 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23329 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23330 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23331 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23332 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23333 - RNA, 4039 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23334 - RNA, 4039 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23335 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23336 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23337 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23338 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23339 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23340 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23341 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23342 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23343 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23344 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23345 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23346 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23347 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23348 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23349 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23350 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23351 - RNA, 4039 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23352 - RNA, 4039 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23353 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23354 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23355 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23356 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23357 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23358 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23359 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23360 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23361 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23362 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23363 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23364 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23365 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23366 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23367 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23368 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23369 - skipped

SEQ ID NO: 23370 - RNA, 4039 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23371 - RNA, 4039 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23372 - RNA, 4039 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23373 - RNA, 4039 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23374 - RNA, 4039 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23375 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23376 - RNA, 4039 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23377 - RNA, 4039 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23378 - RNA, 4039 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23379 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23380 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23381 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23382 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23383 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23384 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23385 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23386 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23387 - RNA, 4039 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23388 - RNA, 4039 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23389 - RNA, 4039 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23390 - RNA, 4039 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23391 - RNA, 4039 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23392 - RNA, 4039 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23393 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23394 - RNA, 4039 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23395 - RNA, 4039 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23396 - RNA, 4039 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23397 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23398 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23399 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23400 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23401 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23402 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23403 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23404 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23405-23528 - skipped (124 entries)

SEQ ID NO: 23529 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H) R10357
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23530 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G) R10361
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23531 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V) R10384
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23532 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G) R10631
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23533 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I) R10385
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23534 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G) R10614
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23535 - RNA, 4094 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23536 - RNA, 4094 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23537 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23538 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23539 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23540 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23541 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23542 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23543 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23544 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23545 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23546 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23547 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23548 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23549 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23550 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23551 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23552 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23553 - RNA, 4094 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23554 - RNA, 4094 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23555 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23556 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23557 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23558 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23559 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23560 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23561 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23562 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23563 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23564 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23565 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23566 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23567 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23568 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23569 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23570 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23571 - RNA, 4094 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23572 - RNA, 4094 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23573 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23574 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23575 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23576 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23577 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23578 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23579 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23580 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23581 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23582 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23583 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23584 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23585 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23586 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23587 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23588 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23589 - skipped

SEQ ID NO: 23590 - RNA, 4094 nt, Artificial Sequence
  SARS-CoV-2/Wuhan/WIV05/2019__EPI_ISL_402128 spike protein mRNA gc mod (1-1273)(K986P_V987P_ D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23591 - RNA, 4094 nt, Artificial Sequence
  SARS-CoV-2/Wuhan/WIV05/2019__EPI_ISL_402128 spike protein mRNA gc mod (1-1273)(K986P_V987P_A222V_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23592 - RNA, 4094 nt, Artificial Sequence
  SARS-CoV-2/Wuhan/WIV05/2019__EPI_ISL_402128 spike protein mRNA gc mod (1-1273)(K986P_V987P_N439K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23593 - RNA, 4094 nt, Artificial Sequence
  SARS-CoV-2/Wuhan/WIV05/2019__EPI_ISL_402128 spike protein mRNA gc mod (1-1273)(K986P_V987P_S477N_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23594 - RNA, 4094 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23595 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23596 - RNA, 4094 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23597 - RNA, 4094 nt, Artificial Sequence
  SARS-CoV-2/Wuhan/WIV05/2019__EPI_ISL_402128 spike protein mRNA gc mod (1-1273)(K986P_V987P_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23598 - RNA, 4094 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23599 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23600 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23601 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23602 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23603 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23604 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23605 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23606 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23607 - RNA, 4094 nt, Artificial Sequence
  SARS-CoV-2/Wuhan/WIV05/2019__EPI_ISL_402128 spike protein mRNA gc mod (1-1273)(K986P_V987P)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23608 - RNA, 4094 nt, Artificial Sequence
  SARS-CoV-2/Wuhan/WIV05/2019__EPI_ISL_402128 spike protein mRNA gc mod (1-1273)(K986P_V987P_ D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23609 - RNA, 4094 nt, Artificial Sequence
  SARS-CoV-2/Wuhan/WIV05/2019__EPI_ISL_402128 spike protein mRNA gc mod (1-1273)(K986P_V987P_A222V_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23610 - RNA, 4094 nt, Artificial Sequence
  SARS-CoV-2/Wuhan/WIV05/2019__EPI_ISL_402128 spike protein mRNA gc mod (1-1273)(K986P_V987P_N439K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23611 - RNA, 4094 nt, Artificial Sequence
  SARS-CoV-2/Wuhan/WIV05/2019__EPI_ISL_402128 spike protein mRNA gc mod (1-1273)(K986P_V987P_S477N_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23612 - RNA, 4094 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23613 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23614 - RNA, 4094 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23615 - RNA, 4094 nt, Artificial Sequence
  SARS-CoV-2/Wuhan/WIV05/2019__EPI_ISL_402128 spike protein mRNA gc mod (1-1273)(K986P_V987P_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23616 - RNA, 4094 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23617 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23618 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23619 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23620 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23621 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23622 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23623 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23624 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23625-24836 - skipped (1212 entries)

SEQ ID NO: 24837 - RNA, 4070 nt, Artificial Sequence
  SARS-CoV-2/Wuhan/WIV05/2019__EPI_ISL_402128 spike protein mRNA gc (1-1273)(K986P_V987P) R10153, R10712, R10728
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24838 - RNA, 4070 nt, Artificial Sequence
  SARS-CoV-2/Wuhan/WIV05/2019__EPI_ISL_402128 spike protein mRNA gc (1-1273)(K986P_V987P_ D614G) R10811
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24839 - RNA, 4070 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24840 - RNA, 4070 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24841 - RNA, 4070 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24842 - RNA, 4070 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24843 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24844 - RNA, 4070 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24845 - RNA, 4070 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24846 - RNA, 4070 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24847 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24848 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24849 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24850 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24851 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V) R10452
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24852 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24853 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24854 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24855 - RNA, 4070 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24856 - RNA, 4070 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24857 - RNA, 4070 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24858 - RNA, 4070 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24859 - RNA, 4070 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24860 - RNA, 4070 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24861 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24862 - RNA, 4070 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24863 - RNA, 4070 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24864 - RNA, 4070 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24865 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24866 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24867 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24868 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24869 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24870 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24871 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24872 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24873 - RNA, 4070 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24874 - RNA, 4070 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24875 - RNA, 4070 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24876 - RNA, 4070 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24877 - RNA, 4070 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24878 - RNA, 4070 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24879 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24880 - RNA, 4070 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24881 - RNA, 4070 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24882 - RNA, 4070 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24883 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24884 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24885 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24886 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24887 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24888 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24889 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24890 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24891 - RNA, 4070 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24892 - RNA, 4070 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24893 - RNA, 4070 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24894 - RNA, 4070 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24895 - RNA, 4070 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24896 - RNA, 4070 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24897 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24898 - RNA, 4070 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24899 - RNA, 4070 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24900 - RNA, 4070 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24901 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24902 - RNA, 4064 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24903 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24904 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24905 - RNA, 4061 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24906 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24907 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24908 - RNA, 4070 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24909 - RNA, 4070 nt, Artificial Sequence
  SARS-CoV-2/Wuhan/WIV05/2019__EPI_ISL_402128 spike protein mRNA gc mod (1-1273)(K986P_V987P)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24910 - RNA, 4070 nt, Artificial Sequence
  SARS-CoV-2/Wuhan/WIV05/2019__EPI_ISL_402128 spike protein mRNA gc mod (1-1273)(K986P_V987P_ D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24911 - RNA, 4070 nt, Artificial Sequence
  SARS-CoV-2/Wuhan/WIV05/2019__EPI_ISL_402128 spike protein mRNA gc mod (1-1273)(K986P_V987P_A222V_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24912 - RNA, 4070 nt, Artificial Sequence
  SARS-CoV-2/Wuhan/WIV05/2019__EPI_ISL_402128 spike protein mRNA gc mod (1-1273)(K986P_V987P_N439K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24913 - RNA, 4070 nt, Artificial Sequence
  SARS-CoV-2/Wuhan/WIV05/2019__EPI_ISL_402128 spike protein mRNA gc mod (1-1273)(K986P_V987P_S477N_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24914 - RNA, 4070 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24915 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24916 - RNA, 4070 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24917 - RNA, 4070 nt, Artificial Sequence
  SARS-CoV-2/Wuhan/WIV05/2019__EPI_ISL_402128 spike protein mRNA gc mod (1-1273)(K986P_V987P_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24918 - RNA, 4070 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24919 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24920 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24921 - RNA, 4061 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24922 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24923 - RNA, 4061 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24924 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24925 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24926 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24927 - RNA, 4070 nt, Artificial Sequence
  SARS-CoV-2/Wuhan/WIV05/2019__EPI_ISL_402128 spike protein mRNA gc mod (1-1273)(K986P_V987P)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24928 - RNA, 4070 nt, Artificial Sequence
  SARS-CoV-2/Wuhan/WIV05/2019__EPI_ISL_402128 spike protein mRNA gc mod (1-1273)(K986P_V987P_ D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24929 - RNA, 4070 nt, Artificial Sequence
  SARS-CoV-2/Wuhan/WIV05/2019__EPI_ISL_402128 spike protein mRNA gc mod (1-1273)(K986P_V987P_A222V_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24930 - RNA, 4070 nt, Artificial Sequence
  SARS-CoV-2/Wuhan/WIV05/2019__EPI_ISL_402128 spike protein mRNA gc mod (1-1273)(K986P_V987P_N439K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24931 - RNA, 4070 nt, Artificial Sequence
  SARS-CoV-2/Wuhan/WIV05/2019__EPI_ISL_402128 spike protein mRNA gc mod (1-1273)(K986P_V987P_S477N_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24932 - RNA, 4070 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24933 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24934 - RNA, 4070 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24935 - RNA, 4070 nt, Artificial Sequence
  SARS-CoV-2/Wuhan/WIV05/2019__EPI_ISL_402128 spike protein mRNA gc mod (1-1273)(K986P_V987P_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24936 - RNA, 4070 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24937 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24938 - RNA, 4064 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24939 - RNA, 4061 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24940 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24941 - RNA, 4061 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24942 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24943 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24944 - RNA, 4070 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24945-26632 - skipped (1688 entries)

SEQ ID NO: 26633 - RNA, 4100 nt, Artificial Sequence
  SARS-CoV-2/Wuhan/WIV05/2019__EPI_ISL_402128 spike protein mRNA gc (1-1273)(K986P_V987P)
gggaaauaagagagaaaagaagaguaagaagaaauauaagaccccggcgccgccaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugauaauaggcuggagccucgguggccuagcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 26634-26906 - skipped (273 entries)

SEQ ID NO: 26907 - RNA, 4283 nt, Artificial Sequence
  SARS-CoV-2/Wuhan/WIV05/2019__EPI_ISL_402128 spike protein mRNA gc mod (1-1273)(K986P_V987P)
agaauaaacuaguauucuucugguccccacagacucagagagaacccgccaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaugacucgagcugguacugcaugcacgcaaugcuagcugccccuuucccguccuggguaccccgagucucccccgaccucgggucccagguaugcucccaccuccaccugccccacucaccaccucugcuaguuccagacaccucccaagcacgcagcaaugcagcucaaaacgcuuagccuagccacacccccacgggaaacagcagugauuaaccuuuagcaauaaacgaaaguuuaacuaagcuauacuaaccccaggguuggucaauuucgugccagccacacccuggagcuagcaaaaaaaaaaaaaaaaaaaaaaaaaaaaaagcauaugacuaaaaaaaaaaaaaaaaaaaaaaaaaaaaaaaaaaaaaaaaaaaaaaaaaaaaaaaaaaaaaaaaaaaaaa

SEQ ID NO: 26908-26991 - skipped (84 entries)

SEQ ID NO: 26992 - protein, 291 aa, Artificial Sequence
  SARS-CoV-2/Wuhan/WIV05/2019__EPI_ISL_402128__spike protein (13-303)
SQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTL

SEQ ID NO: 26993 - protein, 93 aa, Artificial Sequence
  SARS-CoV-2/Wuhan/WIV05/2019__EPI_ISL_402128__spike protein (613-705)
QDVNCTEVPVAIHADQLTPTWRVYSTGSNVFQTRAGCLIGAEHVNNSYECDIPIGAGICASYQTQTNSPRRARSVASQSIIAYTMSLGAENSV

SEQ ID NO: 26994 - protein, 5 aa, Artificial Sequence
  SARS-CoV-2/Wuhan/WIV05/2019__EPI_ISL_402128__spike protein (681-685)
PRRAR

SEQ ID NO: 26995 - protein, 179 aa, Artificial Sequence
  SARS-CoV-2/Wuhan/WIV05/2019__EPI_ISL_402128__spike protein (985-1163)
DKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPD

SEQ ID NO: 26996 - DNA, 195 bp, Artificial Sequence
  PSMB3-v4 3'-UTR
ggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 26997 - RNA, 195 nt, Artificial Sequence
  PSMB3-v42 3'-UTR
ggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 26998 - DNA, 171 bp, Artificial Sequence
  PSMB3-v5 3'-UTR
ggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 26999 - RNA, 171 nt, Artificial Sequence
  PSMB3-v5 3'-UTR
ggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27000 - DNA, 202 bp, Artificial Sequence
  muag-v8 3'-UTR
ggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 27001 - RNA, 202 nt, Artificial Sequence
  muag-v8 3'-UTR
ggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 27002 - DNA, 172 bp, Artificial Sequence
  muag-v9 3'-UTR
ggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcaaaggctcttttcagagccaccagaatt

SEQ ID NO: 27003 - RNA, 172 nt, Artificial Sequence
  muag-v9 3'-UTR
ggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27004 - RNA, 98 nt, Artificial Sequence
  mRNA 3'-end A64-N5-histoneSL-N5
aaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27005 - RNA, 104 nt, Artificial Sequence
  mRNA 3'-end A64-N5-histoneSL-N5
auuaauaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27006 - RNA, 104 nt, Artificial Sequence
  mRNA 3'-end A64-N5-histoneSL-N5
agaucuaaaaaaaaaaaaaaaaaaaaaaaaaaaaaaaaaaaaaaaaaaaaaaaaaaaaaaaaaaaaaaaaugcaucaaaggcucuuuucagagccaccagaauu

SEQ ID NO: 27007 - protein, 223 aa, Artificial Sequence; identical to SEQ ID NO: 13243
  SARS-CoV-2/Wuhan/WIV05/2019__EPI_ISL_402128 spike protein (319-541)(K986P_V987P_ D614G)

SEQ ID NO: 27008 - protein, 223 aa, Artificial Sequence; identical to SEQ ID NO: 13243
  SARS-CoV-2/Wuhan/WIV05/2019__EPI_ISL_402128 spike protein (319-541)(K986P_V987P_A222V_D614G)

SEQ ID NO: 27009 - protein, 223 aa, Artificial Sequence
  SARS-CoV-2/Wuhan/WIV05/2019__EPI_ISL_402128 spike protein (319-541)(K986P_V987P_N439K_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSKNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 27010 - protein, 223 aa, Artificial Sequence
  SARS-CoV-2/Wuhan/WIV05/2019__EPI_ISL_402128 spike protein (319-541)(K986P_V987P_S477N_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNF

SEQ ID NO: 27011 - protein, 223 aa, Artificial Sequence
  SARS-CoV-2/Wuhan/WIV05/2019__EPI_ISL_402128 spike protein (319-541)(K986P_V987P_N501Y_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNF

SEQ ID NO: 27012 - protein, 223 aa, Artificial Sequence; identical to SEQ ID NO: 13243
  SARS-CoV-2/Wuhan/WIV05/2019__EPI_ISL_402128 spike protein (319-541)(K986P_V987P_H69del_V70del_D614G)

SEQ ID NO: 27013 - protein, 223 aa, Artificial Sequence
  SARS-CoV-2/Wuhan/WIV05/2019__EPI_ISL_402128 spike protein (319-541)(K986P_V987P_Y453F_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 27014 - protein, 223 aa, Artificial Sequence; identical to SEQ ID NO: 13243
  SARS-CoV-2/Wuhan/WIV05/2019__EPI_ISL_402128 spike protein (319-541)(K986P_V987P_D614G_I692V)

SEQ ID NO: 27015 - protein, 223 aa, Artificial Sequence; identical to SEQ ID NO: 13243
  SARS-CoV-2/Wuhan/WIV05/2019__EPI_ISL_402128 spike protein (319-541)(K986P_V987P_D614G_M1229I)

SEQ ID NO: 27016 - protein, 223 aa, Artificial Sequence
  SARS-CoV-2/Wuhan/WIV05/2019__EPI_ISL_402128 spike protein (319-541)(K986P_V987P_H69del_V70del_A222V_Y453F_S477N_D614G_I692V )
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGNTPCNGVEGFNCYFPLQSYGFQPTNGVGYQPYRVVVLSFELLHAPATVCGPKKSTNLVKNKCVNF

SEQ ID NO: 27017 - protein, 223 aa, Artificial Sequence; identical to SEQ ID NO: 27013
  SARS-CoV-2/Wuhan/WIV05/2019__EPI_ISL_402128 spike protein (319-541)(K986P_V987P_H69del_V70del_Y453F_D614G_I692V_M1229I)

SEQ ID NO: 27018 - protein, 223 aa, Artificial Sequence; identical to SEQ ID NO: 27011
  SARS-CoV-2/Wuhan/WIV05/2019__EPI_ISL_402128 spike protein (319-541)(K986P_V987P_H69del_V70del_Y144del_N501Y_A570D_D614G_P68 1H_T716I_S982A_D1118H)

SEQ ID NO: 27019 - protein, 223 aa, Artificial Sequence
  SARS-CoV-2/Wuhan/WIV05/2019__EPI_ISL_402128 spike protein (319-541)(K986P_V987P_K417N_E484K_N501Y_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNF

SEQ ID NO: 27020 - protein, 223 aa, Artificial Sequence; identical to SEQ ID NO: 27019
  SARS-CoV-2/Wuhan/WIV05/2019__EPI_ISL_402128 spike protein (319-541)(K986P_V987P_L18F_D80A_D215G_L242del_A243del_L244del_R24 6I_K417N_E484K_N501Y_D614G_A701V)

SEQ ID NO: 27021 - protein, 223 aa, Artificial Sequence
  SARS-CoV-2/Wuhan/WIV05/2019__EPI_ISL_402128 spike protein (319-541)(K986P_V987P_E484K_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNF

SEQ ID NO: 27022 - protein, 223 aa, Artificial Sequence
  SARS-CoV-2/Wuhan/WIV05/2019__EPI_ISL_402128 spike protein (319-541)(K986P_V987P_L18F_T20N_P26S_D138Y_R190S_K417T_E484K_N501 Y_D614G_H655Y_T1027I)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNF

SEQ ID NO: 27023 - protein, 223 aa, Artificial Sequence
  SARS-CoV-2/Wuhan/WIV05/2019__EPI_ISL_402128 spike protein (319-541)(K986P_V987P_S13I_W152C_L452R_D614G)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 27024 - protein, 223 aa, Artificial Sequence
  SARS-CoV-2/Wuhan/WIV05/2019__EPI_ISL_402128 spike protein (319-541)(K986P_V987P_H69del_V70del_Y144del_E484K_N501Y_A570D_D61 4G_P681H_T716I_S982A_D1118H)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNF

SEQ ID NO: 27025 - protein, 223 aa, Artificial Sequence; identical to SEQ ID NO: 27019
  SARS-CoV-2/Wuhan/WIV05/2019__EPI_ISL_402128 spike protein (319-541)(K986P_V987P_L18F_D80A_D215G_L242del_A243del_L244del_K41 7N_E484K_N501Y_D614G_A701V)

SEQ ID NO: 27026 - protein, 223 aa, Artificial Sequence; identical to SEQ ID NO: 27021
  SARS-CoV-2/Wuhan/WIV05/2019__EPI_ISL_402128 spike protein (319-541)(K986P_V987P_Q52R_A67V_H69del_V70del_Y144del_E484K_D614G _Q677H_F888L)

SEQ ID NO: 27027 - protein, 223 aa, Artificial Sequence; identical to SEQ ID NO: 27021
  SARS-CoV-2/Wuhan/WIV05/2019__EPI_ISL_402128 spike protein (319-541)(K986P_V987P_A67V_H69del_V70del_Y144del_E484K_D614G_Q677 H_F888L)

SEQ ID NO: 27028 - protein, 223 aa, Artificial Sequence; identical to SEQ ID NO: 27022
  SARS-CoV-2/Wuhan/WIV05/2019__EPI_ISL_402128 spike protein (319-541)(K986P_V987P_L18F_T20N_P26S_D138Y_R190S_K417T_E484K_N501 Y_D614G_H655Y_T1027I_V1176F)

SEQ ID NO: 27029 - protein, 223 aa, Artificial Sequence; identical to SEQ ID NO: 27021
  SARS-CoV-2/Wuhan/WIV05/2019__EPI_ISL_402128 spike protein (319-541)(K986P_V987P_E484K_D614G_V1176F)

SEQ ID NO: 27030 - protein, 223 aa, Artificial Sequence; identical to SEQ ID NO: 27023
  SARS-CoV-2/Wuhan/WIV05/2019__EPI_ISL_402128 spike protein (319-541)(K986P_V987P_L452R_D614G_P681R)

SEQ ID NO: 27031 - protein, 223 aa, Artificial Sequence
  SARS-CoV-2/Wuhan/WIV05/2019__EPI_ISL_402128 spike protein (319-541)(K986P_V987P_E154K_L452R_E484Q_D614G_P681R_Q1071H)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNF

SEQ ID NO: 27032 - protein, 223 aa, Artificial Sequence
  SARS-CoV-2/Wuhan/WIV05/2019__EPI_ISL_402128 spike protein (319-541)(K986P_V987P_T19R_F157del_R158del_L452R_T478K_D614G_P681 R_D950N)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNF

SEQ ID NO: 27033 - protein, 223 aa, Artificial Sequence
  SARS-CoV-2/Wuhan/WIV05/2019__EPI_ISL_402128 spike protein (319-541)(K986P_V987P_G75V_T76I_R246del_S247del_Y248del_L249del_T 250del_P251del_G252del_L452Q_F490S_D614G_T859N)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYQYRLFRKSNLKPFERDISTEIYQAGSTPCNGVEGFNCYSPLQSYGFQPTNGVGYQPYRVVVLSFELLHAPATVCGPKKSTNLVKNKCVNF

SEQ ID NO: 27034 - protein, 223 aa, Artificial Sequence; identical to SEQ ID NO: 27009
  SARS-CoV-2/Wuhan/WIV05/2019__EPI_ISL_402128 spike protein (319-541)(K986P_V987P_H69del_V70del_N439K_D614G)

SEQ ID NO: 27035 - protein, 223 aa, Artificial Sequence; identical to SEQ ID NO: 27021
  SARS-CoV-2/Wuhan/WIV05/2019__EPI_ISL_402128 spike protein (319-541)(K986P_V987P_L5F_T95I_D253G_E484K_D614G_A701V)

SEQ ID NO: 27036 - protein, 223 aa, Artificial Sequence; identical to SEQ ID NO: 27010
  SARS-CoV-2/Wuhan/WIV05/2019__EPI_ISL_402128 spike protein (319-541)(K986P_V987P_L5F_T95I_D253G_S477N_D614G_Q957R)

SEQ ID NO: 27037 - protein, 223 aa, Artificial Sequence
  SARS-CoV-2/Wuhan/WIV05/2019__EPI_ISL_402128 spike protein (319-541)(K986P_V987P_F157L_V367F_Q613H_P681R)
RVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 27038 - protein, 223 aa, Artificial Sequence; identical to SEQ ID NO: 13243
  SARS-CoV-2/Wuhan/WIV05/2019__EPI_ISL_402128 spike protein (319-541)(K986P_V987P_S254F_D614G_P681R_G769V)

SEQ ID NO: 27039 - protein, 223 aa, Artificial Sequence
  SARS-CoV-2/Wuhan/WIV05/2019__EPI_ISL_402128 spike protein (319-541)(K986P_V987P_P26S_H69del_V70del_V126A_Y144del_L242del_A2 43del_L244del_H245Y_S477N_E484K_D614G_P681H_T1027I_D1118H)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVKGFNCYFPLQSYGFQPTNGVGYQPYRVVVLSFELLHAPATVCGPKKSTNLVKNKCVNF

SEQ ID NO: 27040 - protein, 223 aa, Artificial Sequence
  SARS-CoV-2/Wuhan/WIV05/2019__EPI_ISL_402128 spike protein (319-541)(K986P_V987P_T95I_Y144T_Y145S_ins145N_R346K_E484K_N501Y_ D614G_P681H_D950N)
RVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNF

SEQ ID NO: 27041 - protein, 223 aa, Artificial Sequence
  SARS-CoV-2/Wuhan/WIV05/2019__EPI_ISL_402128 spike protein (319-541)(K986P_V987P_ins214TDR_Q414K_N450K_D614G_T716I)
RVQPTESIVRFPNITNLCPFGEVFNATRFASVYAWNRKRISNCVADYSVLYNSASFSTFKCYGVSPTKLNDLCFTNVYADSFVIRGDEVRQIAPGKTGKIADYNYKLPDDFTGCVIAWNSNNLDSKVGGNYKYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 27042 - protein, 223 aa, Artificial Sequence
  SARS-CoV-2/Wuhan/WIV05/2019__EPI_ISL_402128 spike protein (319-541)(K986P_V987P_T478K_D614G_P681H_T732A)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSKPCNGVEGFNCYFPLQSYGFQPTNGVGYQPYRVVVLSFELLHAPATVCGPKKSTNLVKNKCVNF

SEQ ID NO: 27043 - protein, 223 aa, Artificial Sequence; identical to SEQ ID NO: 27024
  SARS-CoV-2/Wuhan/WIV05/2019__EPI_ISL_402128 spike protein (319-541)(K986P_V987P_E484K_N501Y_D614G_P681H_E1092K_H1101Y_V1176 F)

SEQ ID NO: 27044 - protein, 223 aa, Artificial Sequence
  SARS-CoV-2/Wuhan/WIV05/2019__EPI_ISL_402128 spike protein (319-541)(K986P_V987P_H66D_G142V_Y144del_Y145del_D215G_V483A_D614 G_H655Y_G669S_Q949R_N1187D)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNF

SEQ ID NO: 27045 - protein, 223 aa, Artificial Sequence; identical to SEQ ID NO: 27032
  SARS-CoV-2/Wuhan/WIV05/2019__EPI_ISL_402128 spike protein (319-541)(K986P_V987P_Y144del_L452R_T478K_P681R)

SEQ ID NO: 27046 - protein, 223 aa, Artificial Sequence; identical to SEQ ID NO: 27032
  SARS-CoV-2/Wuhan/WIV05/2019__EPI_ISL_402128 spike protein (319-541)(K986P_V987P_T19R_Y144del_Y145del_L452R_T478K_D614G_P681 R)

SEQ ID NO: 27047 - protein, 201 aa, Artificial Sequence; identical to SEQ ID NO: 13310
  SARS-CoV-2/Wuhan/WIV05/2019__EPI_ISL_402128 spike protein (329-529)(K986P_V987P_ D614G)

SEQ ID NO: 27048 - protein, 201 aa, Artificial Sequence; identical to SEQ ID NO: 13310
  SARS-CoV-2/Wuhan/WIV05/2019__EPI_ISL_402128 spike protein (329-529)(K986P_V987P_A222V_D614G)

SEQ ID NO: 27049 - protein, 201 aa, Artificial Sequence
  SARS-CoV-2/Wuhan/WIV05/2019__EPI_ISL_402128 spike protein (329-529)(K986P_V987P_N439K_D614G)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSKNLDSKVGGNYNYLYRLFRKSNLKPFERDISTEIYQAGSTPCNGVEGFNCYFPLQSYGFQPTNGVGYQPYRVVVLSFELLHAPATVCGPKK

SEQ ID NO: 27050 - protein, 201 aa, Artificial Sequence
  SARS-CoV-2/Wuhan/WIV05/2019__EPI_ISL_402128 spike protein (329-529)(K986P_V987P_S477N_D614G)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKK

SEQ ID NO: 27051 - protein, 201 aa, Artificial Sequence
  SARS-CoV-2/Wuhan/WIV05/2019__EPI_ISL_402128 spike protein (329-529)(K986P_V987P_N501Y_D614G)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKK

SEQ ID NO: 27052 - protein, 201 aa, Artificial Sequence; identical to SEQ ID NO: 13310
  SARS-CoV-2/Wuhan/WIV05/2019__EPI_ISL_402128 spike protein (329-529)(K986P_V987P_H69del_V70del_D614G)

SEQ ID NO: 27053 - protein, 201 aa, Artificial Sequence
  SARS-CoV-2/Wuhan/WIV05/2019__EPI_ISL_402128 spike protein (329-529)(K986P_V987P_Y453F_D614G)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKK

SEQ ID NO: 27054 - protein, 201 aa, Artificial Sequence; identical to SEQ ID NO: 13310
  SARS-CoV-2/Wuhan/WIV05/2019__EPI_ISL_402128 spike protein (329-529)(K986P_V987P_D614G_I692V)

SEQ ID NO: 27055 - protein, 201 aa, Artificial Sequence; identical to SEQ ID NO: 13310
  SARS-CoV-2/Wuhan/WIV05/2019__EPI_ISL_402128 spike protein (329-529)(K986P_V987P_D614G_M1229I)

SEQ ID NO: 27056 - protein, 201 aa, Artificial Sequence
  SARS-CoV-2/Wuhan/WIV05/2019__EPI_ISL_402128 spike protein (329-529)(K986P_V987P_H69del_V70del_A222V_Y453F_S477N_D614G_I692V )
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGNTPCNGVEGFNCYFPLQSYGFQPTNGVGYQPYRVVVLSFELLHAPATVCGPKK

SEQ ID NO: 27057 - protein, 201 aa, Artificial Sequence; identical to SEQ ID NO: 27053
  SARS-CoV-2/Wuhan/WIV05/2019__EPI_ISL_402128 spike protein (329-529)(K986P_V987P_H69del_V70del_Y453F_D614G_I692V_M1229I)

SEQ ID NO: 27058 - protein, 201 aa, Artificial Sequence; identical to SEQ ID NO: 27051
  SARS-CoV-2/Wuhan/WIV05/2019__EPI_ISL_402128 spike protein (329-529)(K986P_V987P_H69del_V70del_Y144del_N501Y_A570D_D614G_P68 1H_T716I_S982A_D1118H)

SEQ ID NO: 27059 - protein, 201 aa, Artificial Sequence
  SARS-CoV-2/Wuhan/WIV05/2019__EPI_ISL_402128 spike protein (329-529)(K986P_V987P_K417N_E484K_N501Y_D614G)
FPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKK

SEQ ID NO: 27060 - protein, 201 aa, Artificial Sequence; identical to SEQ ID NO: 27059
  SARS-CoV-2/Wuhan/WIV05/2019__EPI_ISL_402128 spike protein (329-529)(K986P_V987P_L18F_D80A_D215G_L242del_A243del_L244del_R24 6I_K417N_E484K_N501Y_D614G_A701V)

SEQ ID NO: 27061 - protein, 201 aa, Artificial Sequence
  SARS-CoV-2/Wuhan/WIV05/2019__EPI_ISL_402128 spike protein (329-529)(K986P_V987P_E484K_D614G)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKK

SEQ ID NO: 27062 - protein, 201 aa, Artificial Sequence
  SARS-CoV-2/Wuhan/WIV05/2019__EPI_ISL_402128 spike protein (329-529)(K986P_V987P_L18F_T20N_P26S_D138Y_R190S_K417T_E484K_N501 Y_D614G_H655Y_T1027I)
FPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKK

SEQ ID NO: 27063 - protein, 201 aa, Artificial Sequence
  SARS-CoV-2/Wuhan/WIV05/2019__EPI_ISL_402128 spike protein (329-529)(K986P_V987P_S13I_W152C_L452R_D614G)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKK

SEQ ID NO: 27064 - protein, 201 aa, Artificial Sequence
  SARS-CoV-2/Wuhan/WIV05/2019__EPI_ISL_402128 spike protein (329-529)(K986P_V987P_H69del_V70del_Y144del_E484K_N501Y_A570D_D61 4G_P681H_T716I_S982A_D1118H)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKK

SEQ ID NO: 27065 - protein, 201 aa, Artificial Sequence; identical to SEQ ID NO: 27059
  SARS-CoV-2/Wuhan/WIV05/2019__EPI_ISL_402128 spike protein (329-529)(K986P_V987P_L18F_D80A_D215G_L242del_A243del_L244del_K41 7N_E484K_N501Y_D614G_A701V)

SEQ ID NO: 27066 - protein, 201 aa, Artificial Sequence; identical to SEQ ID NO: 27061
  SARS-CoV-2/Wuhan/WIV05/2019__EPI_ISL_402128 spike protein (329-529)(K986P_V987P_Q52R_A67V_H69del_V70del_Y144del_E484K_D614G _Q677H_F888L)

SEQ ID NO: 27067 - protein, 201 aa, Artificial Sequence; identical to SEQ ID NO: 27061
  SARS-CoV-2/Wuhan/WIV05/2019__EPI_ISL_402128 spike protein (329-529)(K986P_V987P_A67V_H69del_V70del_Y144del_E484K_D614G_Q677 H_F888L)

SEQ ID NO: 27068 - protein, 201 aa, Artificial Sequence; identical to SEQ ID NO: 27062
  SARS-CoV-2/Wuhan/WIV05/2019__EPI_ISL_402128 spike protein (329-529)(K986P_V987P_L18F_T20N_P26S_D138Y_R190S_K417T_E484K_N501 Y_D614G_H655Y_T1027I_V1176F)

SEQ ID NO: 27069 - protein, 201 aa, Artificial Sequence; identical to SEQ ID NO: 27061
  SARS-CoV-2/Wuhan/WIV05/2019__EPI_ISL_402128 spike protein (329-529)(K986P_V987P_E484K_D614G_V1176F)

SEQ ID NO: 27070 - protein, 201 aa, Artificial Sequence; identical to SEQ ID NO: 27063
  SARS-CoV-2/Wuhan/WIV05/2019__EPI_ISL_402128 spike protein (329-529)(K986P_V987P_L452R_D614G_P681R)

SEQ ID NO: 27071 - protein, 201 aa, Artificial Sequence
  SARS-CoV-2/Wuhan/WIV05/2019__EPI_ISL_402128 spike protein (329-529)(K986P_V987P_E154K_L452R_E484Q_D614G_P681R_Q1071H)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKK

SEQ ID NO: 27072 - protein, 201 aa, Artificial Sequence
  SARS-CoV-2/Wuhan/WIV05/2019__EPI_ISL_402128 spike protein (329-529)(K986P_V987P_T19R_F157del_R158del_L452R_T478K_D614G_P681 R_D950N)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKK

SEQ ID NO: 27073 - protein, 201 aa, Artificial Sequence
  SARS-CoV-2/Wuhan/WIV05/2019__EPI_ISL_402128 spike protein (329-529)(K986P_V987P_G75V_T76I_R246del_S247del_Y248del_L249del_T 250del_P251del_G252del_L452Q_F490S_D614G_T859N)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYQYRLFRKSNLKPFERDISTEIYQAGSTPCNGVEGFNCYSPLQSYGFQPTNGVGYQPYRVVVLSFELLHAPATVCGPKK

SEQ ID NO: 27074 - protein, 201 aa, Artificial Sequence; identical to SEQ ID NO: 27049
  SARS-CoV-2/Wuhan/WIV05/2019__EPI_ISL_402128 spike protein (329-529)(K986P_V987P_H69del_V70del_N439K_D614G)

SEQ ID NO: 27075 - protein, 201 aa, Artificial Sequence; identical to SEQ ID NO: 27061
  SARS-CoV-2/Wuhan/WIV05/2019__EPI_ISL_402128 spike protein (329-529)(K986P_V987P_L5F_T95I_D253G_E484K_D614G_A701V)

SEQ ID NO: 27076 - protein, 201 aa, Artificial Sequence; identical to SEQ ID NO: 27050
  SARS-CoV-2/Wuhan/WIV05/2019__EPI_ISL_402128 spike protein (329-529)(K986P_V987P_L5F_T95I_D253G_S477N_D614G_Q957R)

SEQ ID NO: 27077 - protein, 201 aa, Artificial Sequence
  SARS-CoV-2/Wuhan/WIV05/2019__EPI_ISL_402128 spike protein (329-529)(K986P_V987P_F157L_V367F_Q613H_P681R)
FPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKK

SEQ ID NO: 27078 - protein, 201 aa, Artificial Sequence; identical to SEQ ID NO: 13310
  SARS-CoV-2/Wuhan/WIV05/2019__EPI_ISL_402128 spike protein (329-529)(K986P_V987P_S254F_D614G_P681R_G769V)

SEQ ID NO: 27079 - protein, 201 aa, Artificial Sequence
  SARS-CoV-2/Wuhan/WIV05/2019__EPI_ISL_402128 spike protein (329-529)(K986P_V987P_P26S_H69del_V70del_V126A_Y144del_L242del_A2 43del_L244del_H245Y_S477N_E484K_D614G_P681H_T1027I_D1118H)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVKGFNCYFPLQSYGFQPTNGVGYQPYRVVVLSFELLHAPATVCGPKK

SEQ ID NO: 27080 - protein, 201 aa, Artificial Sequence
  SARS-CoV-2/Wuhan/WIV05/2019__EPI_ISL_402128 spike protein (329-529)(K986P_V987P_T95I_Y144T_Y145S_ins145N_R346K_E484K_N501Y_ D614G_P681H_D950N)
FPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKK

SEQ ID NO: 27081 - protein, 201 aa, Artificial Sequence
  SARS-CoV-2/Wuhan/WIV05/2019__EPI_ISL_402128 spike protein (329-529)(K986P_V987P_ins214TDR_Q414K_N450K_D614G_T716I)
FPNITNLCPFGEVFNATRFASVYAWNRKRISNCVADYSVLYNSASFSTFKCYGVSPTKLNDLCFTNVYADSFVIRGDEVRQIAPGKTGKIADYNYKLPDDFTGCVIAWNSNNLDSKVGGNYKYLYRLFRKSNLKPFERDISTEIYQAGSTPCNGVEGFNCYFPLQSYGFQPTNGVGYQPYRVVVLSFELLHAPATVCGPKK

SEQ ID NO: 27082 - protein, 201 aa, Artificial Sequence
  SARS-CoV-2/Wuhan/WIV05/2019__EPI_ISL_402128 spike protein (329-529)(K986P_V987P_T478K_D614G_P681H_T732A)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSKPCNGVEGFNCYFPLQSYGFQPTNGVGYQPYRVVVLSFELLHAPATVCGPKK

SEQ ID NO: 27083 - protein, 201 aa, Artificial Sequence; identical to SEQ ID NO: 27064
  SARS-CoV-2/Wuhan/WIV05/2019__EPI_ISL_402128 spike protein (329-529)(K986P_V987P_E484K_N501Y_D614G_P681H_E1092K_H1101Y_V1176 F)

SEQ ID NO: 27084 - protein, 201 aa, Artificial Sequence
  SARS-CoV-2/Wuhan/WIV05/2019__EPI_ISL_402128 spike protein (329-529)(K986P_V987P_H66D_G142V_Y144del_Y145del_D215G_V483A_D614 G_H655Y_G669S_Q949R_N1187D)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKK

SEQ ID NO: 27085 - protein, 201 aa, Artificial Sequence; identical to SEQ ID NO: 27072
  SARS-CoV-2/Wuhan/WIV05/2019__EPI_ISL_402128 spike protein (329-529)(K986P_V987P_Y144del_L452R_T478K_P681R)

SEQ ID NO: 27086 - protein, 201 aa, Artificial Sequence; identical to SEQ ID NO: 27072
  SARS-CoV-2/Wuhan/WIV05/2019__EPI_ISL_402128 spike protein (329-529)(K986P_V987P_T19R_Y144del_Y145del_L452R_T478K_D614G_P681 R)

SEQ ID NO: 27087 - protein, 1270 aa, Artificial Sequence
  SARS-CoV-2/Wuhan/WIV05/2019__EPI_ISL_402128 spike protein (1-1273)(K986P_V987P_H69del_V70del_Y144del_E484K_N501Y_A570D_D614 G_P681H_T716I_S982A_D1118H)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27088 - protein, 1270 aa, Artificial Sequence
  SARS-CoV-2/Wuhan/WIV05/2019__EPI_ISL_402128 spike protein (1-1273)(K986P_V987P_L18F_D80A_D215G_L242del_A243del_L244del_K417 N_E484K_N501Y_D614G_A701V)
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27089 - protein, 1270 aa, Artificial Sequence
  SARS-CoV-2/Wuhan/WIV05/2019__EPI_ISL_402128 spike protein (1-1273)(K986P_V987P_Q52R_A67V_H69del_V70del_Y144del_E484K_D614G_ Q677H_F888L)
MFVFLVLLPLVSSQCVNLTTRTQLPPAYTNSFTRGVYYPDKVFRSSVLHSTRDLFLPFFSNVTWFHVISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTHTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTLGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27090 - protein, 1270 aa, Artificial Sequence
  SARS-CoV-2/Wuhan/WIV05/2019__EPI_ISL_402128 spike protein (1-1273)(K986P_V987P_A67V_H69del_V70del_Y144del_E484K_D614G_Q677H _F888L)
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTHTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTLGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27091 - protein, 1273 aa, Artificial Sequence
  SARS-CoV-2/Wuhan/WIV05/2019__EPI_ISL_402128 spike protein (1-1273)(K986P_V987P_L18F_T20N_P26S_D138Y_R190S_K417T_E484K_N501Y _D614G_H655Y_T1027I_V1176F)
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27092 - protein, 1273 aa, Artificial Sequence
  SARS-CoV-2/Wuhan/WIV05/2019__EPI_ISL_402128 spike protein (1-1273)(K986P_V987P_E484K_D614G_V1176F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27093 - protein, 1273 aa, Artificial Sequence
  SARS-CoV-2/Wuhan/WIV05/2019__EPI_ISL_402128 spike protein (1-1273)(K986P_V987P_L452R_D614G_P681R)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27094 - protein, 1273 aa, Artificial Sequence
  SARS-CoV-2/Wuhan/WIV05/2019__EPI_ISL_402128 spike protein (1-1273)(K986P_V987P_E154K_L452R_E484Q_D614G_P681R_Q1071H)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27095 - protein, 1271 aa, Artificial Sequence
  SARS-CoV-2/Wuhan/WIV05/2019__EPI_ISL_402128 spike protein (1-1273)(K986P_V987P_T19R_F157del_R158del_L452R_T478K_D614G_P681R _D950N)
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27096 - protein, 1266 aa, Artificial Sequence
  SARS-CoV-2/Wuhan/WIV05/2019__EPI_ISL_402128 spike protein (1-1273)(K986P_V987P_G75V_T76I_R246del_S247del_Y248del_L249del_T2 50del_P251del_G252del_L452Q_F490S_D614G_T859N)
MFVFLVLLPLVSSQCVNLTTRTQLPPAYTNSFTRGVYYPDKVFRSSVLHSTQDLFLPFFSNVTWFHAIHVSGTNVIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYQYRLFRKSNLKPFERDISTEIYQAGSTPCNGVEGFNCYSPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLNVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27097 - protein, 1271 aa, Artificial Sequence
  SARS-CoV-2/Wuhan/WIV05/2019__EPI_ISL_402128 spike protein (1-1273)(K986P_V987P_H69del_V70del_N439K_D614G)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSKNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27098 - protein, 1273 aa, Artificial Sequence
  SARS-CoV-2/Wuhan/WIV05/2019__EPI_ISL_402128 spike protein (1-1273)(K986P_V987P_L5F_T95I_D253G_E484K_D614G_A701V)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27099 - protein, 1273 aa, Artificial Sequence
  SARS-CoV-2/Wuhan/WIV05/2019__EPI_ISL_402128 spike protein (1-1273)(K986P_V987P_L5F_T95I_D253G_S477N_D614G_Q957R)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNARALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27100 - protein, 1273 aa, Artificial Sequence
  SARS-CoV-2/Wuhan/WIV05/2019__EPI_ISL_402128 spike protein (1-1273)(K986P_V987P_F157L_V367F_Q613H_P681R)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYHDVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27101 - protein, 1273 aa, Artificial Sequence
  SARS-CoV-2/Wuhan/WIV05/2019__EPI_ISL_402128 spike protein (1-1273)(K986P_V987P_S254F_D614G_P681R_G769V)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDFSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTVIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27102 - protein, 1267 aa, Artificial Sequence
  SARS-CoV-2/Wuhan/WIV05/2019__EPI_ISL_402128 spike protein (1-1273)(K986P_V987P_P26S_H69del_V70del_V126A_Y144del_L242del_A24 3del_L244del_H245Y_S477N_E484K_D614G_P681H_T1027I_D1118H)
MFVFLVLLPLVSSQCVNLTTRTQLPSAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNAVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLYRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27103 - protein, 1274 aa, Artificial Sequence
  SARS-CoV-2/Wuhan/WIV05/2019__EPI_ISL_402128 spike protein (1-1273)(K986P_V987P_T95I_Y144T_Y145S_ins145N_R346K_E484K_N501Y_D 614G_P681H_D950N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVTSNHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27104 - protein, 1276 aa, Artificial Sequence
  SARS-CoV-2/Wuhan/WIV05/2019__EPI_ISL_402128 spike protein (1-1273)(K986P_V987P_ins214TDR_Q414K_N450K_D614G_T716I)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRTDRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGKTGKIADYNYKLPDDFTGCVIAWNSNNLDSKVGGNYKYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27105 - protein, 1273 aa, Artificial Sequence
  SARS-CoV-2/Wuhan/WIV05/2019__EPI_ISL_402128 spike protein (1-1273)(K986P_V987P_T478K_D614G_P681H_T732A)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPTNFTISVTTEILPVSMAKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27106 - protein, 1273 aa, Artificial Sequence
  SARS-CoV-2/Wuhan/WIV05/2019__EPI_ISL_402128 spike protein (1-1273)(K986P_V987P_E484K_N501Y_D614G_P681H_E1092K_H1101Y_V1176F )
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPRKGVFVSNGTYWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27107 - protein, 1271 aa, Artificial Sequence
  SARS-CoV-2/Wuhan/WIV05/2019__EPI_ISL_402128 spike protein (1-1273)(K986P_V987P_H66D_G142V_Y144del_Y145del_D215G_V483A_D614G _H655Y_G669S_Q949R_N1187D)
MFVFLVLLPLVSSQCVNLTTRTQLPPAYTNSFTRGVYYPDKVFRSSVLHSTQDLFLPFFSNVTWFDAIHVSGTNGTKRFDNPVLPFNDGVYFASTEKSNIIRGWIFGTTLDSKTQSLLIVNNATNVVIKVCEFQFCNDPFLVVHKNNKSWMESEFRVYSSANNCTFEYVSQPFLMDLEGKQGNFKNLREFVFKNIDGYFKIYSKHTPINLVRGLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGASICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLRDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLDEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27108 - protein, 1272 aa, Artificial Sequence
  SARS-CoV-2/Wuhan/WIV05/2019__EPI_ISL_402128 spike protein (1-1273)(K986P_V987P_Y144del_L452R_T478K_P681R)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27109 - protein, 1271 aa, Artificial Sequence
  SARS-CoV-2/Wuhan/WIV05/2019__EPI_ISL_402128 spike protein (1-1273)(K986P_V987P_T19R_Y144del_Y145del_L452R_T478K_D614G_P681R )
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27110 - RNA, 3813 nt, Artificial Sequence
  SARS-CoV-2/Wuhan/WIV05/2019__EPI_ISL_402128 spike protein CDS gc (1-1273)(K986P_V987P_H69del_V70del_Y144del_E484K_N501Y_A570D_D614 G_P681H_T716I_S982A_D1118H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27111 - RNA, 3813 nt, Artificial Sequence
  SARS-CoV-2/Wuhan/WIV05/2019__EPI_ISL_402128 spike protein CDS gc (1-1273)(K986P_V987P_L18F_D80A_D215G_L242del_A243del_L244del_K417 N_E484K_N501Y_D614G_A701V)
auguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacagguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27112 - RNA, 3813 nt, Artificial Sequence
  SARS-CoV-2/Wuhan/WIV05/2019__EPI_ISL_402128 spike protein CDS gc (1-1273)(K986P_V987P_Q52R_A67V_H69del_V70del_Y144del_E484K_D614G_ Q677H_F888L)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgcgaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27113 - RNA, 3813 nt, Artificial Sequence
  SARS-CoV-2/Wuhan/WIV05/2019__EPI_ISL_402128 spike protein CDS gc (1-1273)(K986P_V987P_A67V_H69del_V70del_Y144del_E484K_D614G_Q677H _F888L)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcacaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggacccugggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27114 - RNA, 3822 nt, Artificial Sequence
  SARS-CoV-2/Wuhan/WIV05/2019__EPI_ISL_402128 spike protein CDS gc (1-1273)(K986P_V987P_L18F_T20N_P26S_D138Y_R190S_K417T_E484K_N501Y _D614G_H655Y_T1027I_V1176F)
auguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27115 - RNA, 3822 nt, Artificial Sequence
  SARS-CoV-2/Wuhan/WIV05/2019__EPI_ISL_402128 spike protein CDS gc (1-1273)(K986P_V987P_E484K_D614G_V1176F)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27116 - RNA, 3822 nt, Artificial Sequence
  SARS-CoV-2/Wuhan/WIV05/2019__EPI_ISL_402128 spike protein CDS gc (1-1273)(K986P_V987P_L452R_D614G_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27117 - RNA, 3822 nt, Artificial Sequence
  SARS-CoV-2/Wuhan/WIV05/2019__EPI_ISL_402128 spike protein CDS gc (1-1273)(K986P_V987P_E154K_L452R_E484Q_D614G_P681R_Q1071H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacggggugcagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccacgagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27118 - RNA, 3816 nt, Artificial Sequence
  SARS-CoV-2/Wuhan/WIV05/2019__EPI_ISL_402128 spike protein CDS gc (1-1273)(K986P_V987P_T19R_F157del_R158del_L452R_T478K_D614G_P681R _D950N)
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27119 - RNA, 3801 nt, Artificial Sequence
  SARS-CoV-2/Wuhan/WIV05/2019__EPI_ISL_402128 spike protein CDS gc (1-1273)(K986P_V987P_G75V_T76I_R246del_S247del_Y248del_L249del_T2 50del_P251del_G252del_L452Q_F490S_D614G_T859N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcacgacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccaguaccgccuguuccgcaagagcaaccucaagcccuucgagcgggacaucuccaccgagaucuaccaggccggcagcacccccugcaacgggguggagggcuucaacugcuacagcccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaacgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27120 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_N439K_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27121 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_E484K_D614G_A701V)
auguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27122 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_S477N_D614G_Q957R)
auguucguguucuucguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccggggggcagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccgcgcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27123 - RNA, 3822 nt, Artificial Sequence
  SARS-CoV-2/Wuhan/WIV05/2019__EPI_ISL_402128 spike protein CDS gc (1-1273)(K986P_V987P_F157L_V367F_Q613H_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccacgacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27124 - RNA, 3822 nt, Artificial Sequence
  SARS-CoV-2/Wuhan/WIV05/2019__EPI_ISL_402128 spike protein CDS gc (1-1273)(K986P_V987P_S254F_D614G_P681R_G769V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggugaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27125 - RNA, 3804 nt, Artificial Sequence
  SARS-CoV-2/Wuhan/WIV05/2019__EPI_ISL_402128 spike protein CDS gc (1-1273)(K986P_V987P_P26S_H69del_V70del_V126A_Y144del_L242del_A24 3del_L244del_H245Y_S477N_E484K_D614G_P681H_T1027I_D1118H)
auguucguguuccugguccuccugccccuggugagcucccagugcgugaaccucaccacccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacgccgucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccucuaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27126 - RNA, 3825 nt, Artificial Sequence
  SARS-CoV-2/Wuhan/WIV05/2019__EPI_ISL_402128 spike protein CDS gc (1-1273)(K986P_V987P_T95I_Y144T_Y145S_ins145N_R346K_E484K_N501Y_D 614G_P681H_D950N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugaccagcaaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccaccaaguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcagaacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27127 - RNA, 3831 nt, Artificial Sequence
  SARS-CoV-2/Wuhan/WIV05/2019__EPI_ISL_402128 spike protein CDS gc (1-1273)(K986P_V987P_ins214TDR_Q414K_N450K_D614G_T716I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggcaagaccgggaagaucgccgacuacaacuacaagcugccggacgacuucacgggcugcgugaucgcguggaacagcaacaaccucgacuccaaggucgggggcaacuacaaguaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27128 - RNA, 3822 nt, Artificial Sequence
  SARS-CoV-2/Wuhan/WIV05/2019__EPI_ISL_402128 spike protein CDS gc (1-1273)(K986P_V987P_T478K_D614G_P681H_T732A)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcauggccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27129 - RNA, 3822 nt, Artificial Sequence
  SARS-CoV-2/Wuhan/WIV05/2019__EPI_ISL_402128 spike protein CDS gc (1-1273)(K986P_V987P_E484K_N501Y_D614G_P681H_E1092K_H1101Y_V1176F )
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcaagggcguguucguguccaacgggaccuacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcuucgugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27130 - RNA, 3816 nt, Artificial Sequence
  SARS-CoV-2/Wuhan/WIV05/2019__EPI_ISL_402128 spike protein CDS gc (1-1273)(K986P_V987P_H66D_G142V_Y144del_Y145del_D215G_V483A_D614G _H655Y_G669S_Q949R_N1187D)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucguggugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccagcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcgcgacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccuggacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27131 - RNA, 3819 nt, Artificial Sequence
  SARS-CoV-2/Wuhan/WIV05/2019__EPI_ISL_402128 spike protein CDS gc (1-1273)(K986P_V987P_Y144del_L452R_T478K_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27132 - RNA, 3816 nt, Artificial Sequence
  SARS-CoV-2/Wuhan/WIV05/2019__EPI_ISL_402128 spike protein CDS gc (1-1273)(K986P_V987P_T19R_Y144del_Y145del_L452R_T478K_D614G_P681R )
auguucguguuccugguccuccugccccuggugagcucccagugcgugaaccuccgcacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcgugcacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccgccggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 27133 - RNA, 3813 nt, Artificial Sequence
  SARS-CoV-2/Wuhan/WIV05/2019__EPI_ISL_402128 spike protein CDS gc (1-1273)(K986P_V987P_H69del_V70del_Y144del_E484K_N501Y_A570D_D614 G_P681H_T716I_S982A_D1118H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccuga

SEQ ID NO: 27134 - RNA, 3813 nt, Artificial Sequence
  SARS-CoV-2/Wuhan/WIV05/2019__EPI_ISL_402128 spike protein CDS gc (1-1273)(K986P_V987P_L18F_D80A_D215G_L242del_A243del_L244del_K417 N_E484K_N501Y_D614G_A701V)
auguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcaccgguccuaccucacgccgggcgacagcagcuccggcuggaccgcgggggccgccgccuacuacgugggcuaccugcagccccgcaccuuccugcucaaguacaacgagaacgggaccaucacggacgcggucgacugcgcccuggacccccugagcgagaccaagugcacccucaaguccuucaccguggagaagggcaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggggucagccccaccaagcucaacgaccugugcuucaccaacguguacgccgacuccuucgugauccgcggcgacgagguccggcagaucgcccccgggcagaccggcaacaucgccgacuacaacuacaagcugccggacgacuucacggggugcgugaucgcguggaacagcaacaaccucgacuccaaggugggcggcaacuacaacuaccuguaccgccuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccggguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgcgacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggcgccgggaucugcgccagcuaccagacgcagaccaacuccccgcggcgcgcccggagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccucggggacaucgccgcgcgcgaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgguucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccuggggcagagcaagcggguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgcgagggcguguucguguccaacggcacccacugguucgucacgcagcggaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacguga

SEQ ID NO: 27135 - RNA, 3813 nt, Artificial Sequence
  SARS-CoV-2/Wuhan/WIV05/2019__EPI_ISL_402128 spike protein CDS gc (1-1273)(K986P_V987P_Q52R_A67V_H69del_V70del_Y144del_E484K_D614G_ Q677H_F888L)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccgggaccucuuccugcccuucuucagcaacgucacgugguuccacgugaucuccgggaccaacggcaccaagcgcuucgacaacccggugcugcccuucaacgacggggucuacuucgccagcaccgagaaguccaacaucauccggggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgcgucuacagcuccgccaacaacugcacguucgaguacgugagccagcccuuccugauggaccuggagggcaagcaggggaacuucaagaaccuccgggaguucguguucaagaacaucgacggcuacuucaagaucuacuccaagcacaccccgaucaaccugguccgcgaccugccccagggguucagcgcccucgagccccugguggaccugcccaucggcaucaacaucacccgguuccagacccuccuggcccugcaccgcuccuaccucacgccgggggacagcagcuccggcuggaccgccggcgcggccgccuacuacgugggguaccugcagccccggaccuuccugcucaaguacaacgagaacggcaccaucacggacgccgucgacugcgcgcuggacccccugagcgagaccaagugcacccucaaguccuucaccguggagaaggggaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccggcuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgggacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcgcguguacuccaccgggagcaacgucuuccagacccgggccggcugccucaucggggccgagcacgugaacaacuccuacgagugcgacauccccaucggcgcgggcaucugcgccagcuaccagacgcacaccaacuccccgcgccgggcccgcagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgccgcgcgggaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgcuucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccggcuggacccgcccgaggccgagguccagaucgaccgccucaucaccggccggcugcagagccugcagaccuacgugacccagcagcucauccgcgccgcggagauccgggccagcgccaaccuggccgccaccaagauguccgagugcgugcugggccagagcaagcgcgucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccggcucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacguga

SEQ ID NO: 27136 - RNA, 3813 nt, Artificial Sequence
  SARS-CoV-2/Wuhan/WIV05/2019__EPI_ISL_402128 spike protein CDS gc (1-1273)(K986P_V987P_A67V_H69del_V70del_Y144del_E484K_D614G_Q677H _F888L)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgugaucuccgggaccaacggcaccaagcgguucgacaacccggugcugcccuucaacgacggggucuacuucgccagcaccgagaaguccaacaucauccgcggcuggaucuucgggacgacccucgacagcaagacccagucccugcugaucgugaacaacgcgaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcgggguguccgugaucacgccgggcaccaacaccagcaaccaggucgcggugcuguaccagggcgugaacugcaccgagguccccguggccauccacgccgaccagcugacgcccaccuggcggguguacuccaccgggagcaacgucuuccagacccgcgccggcugccucaucggggccgagcacgugaacaacuccuacgagugcgacauccccaucggcgcgggcaucugcgccagcuaccagacgcacaccaacuccccgcggcgcgcccggagcguggccucccagagcaucaucgcguacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcccugacgggcaucgcgguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccagcgcccuccuggccggcaccaucacguccggguggacccugggcgcgggcgccgcccuccagauccccuucgccaugcagauggcguaccgguucaacgggaucggcgucacccagaacgugcuguacgagaaccagaagcugaucgccaaccaguucaacagcgccaucgggaagauccaggacucccucagcuccaccgccagcgcccugggcaagcugcaggacguggucaaccagaacgcgcaggcccucaacacgcuggugaagcagcuguccagcaacuucggggccaucuccagcgugcucaacgacauccugucccgccuggacccgcccgaggccgagguccagaucgaccggcucaucaccggccgccugcagagccugcagaccuacgugacccagcagcucauccgggccgcggagauccgcgccagcgccaaccuggccgccaccaagauguccgagugcgugcugggccagagcaagcgggucgacuucugcgggaagggcuaccaccucauguccuucccccagagcgcgccccacggggugguguuccugcacgucacguacgugcccgcccaggagaagaacuucaccaccgccccggccaucugccacgacggcaaggcgcacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggcccugguacaucuggcugggcuucaucgccgggcucaucgccaucgucauggugaccaucaugcugugcugcaugaccagcugcugcuccugccugaagggcugcugcagcugcggguccugcugcaaguucgacgaggacgacagcgagccggugcucaagggcgucaagcugcacuacacguga

SEQ ID NO: 27137 - RNA, 3822 nt, Artificial Sequence
  SARS-CoV-2/Wuhan/WIV05/2019__EPI_ISL_402128 spike protein CDS gc (1-1273)(K986P_V987P_L18F_T20N_P26S_D138Y_R190S_K417T_E484K_N501Y _D614G_H655Y_T1027I_V1176F)
auguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcuucgucaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgugauggucaccaucaugcugugcugcaugaccagcugcugcuccugccucaagggcugcugcagcugcggguccugcugcaaguucgacgaggacgacagcgagcccgugcugaagggcgugaagcugcacuacaccuga

SEQ ID NO: 27138 - RNA, 3822 nt, Artificial Sequence
  SARS-CoV-2/Wuhan/WIV05/2019__EPI_ISL_402128 spike protein CDS gc (1-1273)(K986P_V987P_E484K_D614G_V1176F)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacguga

SEQ ID NO: 27139 - RNA, 3822 nt, Artificial Sequence
  SARS-CoV-2/Wuhan/WIV05/2019__EPI_ISL_402128 spike protein CDS gc (1-1273)(K986P_V987P_L452R_D614G_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccaggagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacguga

SEQ ID NO: 27140 - RNA, 3822 nt, Artificial Sequence
  SARS-CoV-2/Wuhan/WIV05/2019__EPI_ISL_402128 spike protein CDS gc (1-1273)(K986P_V987P_E154K_L452R_E484Q_D614G_P681R_Q1071H)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggaugaaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcacccccugcaacggggugcagggcuucaacugcuacuucccccuccaguccuacggguuccagccgaccaacggcgugggguaccagcccuaccgcguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcgcguguacuccaccgggagcaacgucuuccagacccgggccggcugccugaucggggcggagcacgugaacaacuccuacgagugcgacauccccaucggcgccggcaucugcgccagcuaccagacgcagaccaacucccgccggcgcgcccggagcguggcgucccagagcaucaucgccuacaccaugucccucggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacccgcccgaggccgagguccagaucgaccggcugaucaccggccgccugcagagccuccagaccuacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucacguacgugcccgcccacgagaagaacuucaccaccgcccccgccaucugccacgacggcaaggcccacuucccgcgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacacguga

SEQ ID NO: 27141 - RNA, 3816 nt, Artificial Sequence
  SARS-CoV-2/Wuhan/WIV05/2019__EPI_ISL_402128 spike protein CDS gc (1-1273)(K986P_V987P_T19R_F157del_R158del_L452R_T478K_D614G_P681R _D950N)
auguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcguguacuaccacaagaacaacaagagcuggauggaguccgaggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacacgccgaucaaccugguccgggaccugccccagggguucagcgcccucgagccccugguggaccugcccaucggcaucaacaucacccgcuuccagacccuccuggcccugcaccgguccuaccucaccccgggggacagcagcuccggcuggacggcgggcgccgccgccuacuacgugggguaccugcagccccgcaccuuccugcucaaguacaacgagaacggcaccaucaccgacgcggucgacugcgcccuggacccccugagcgagacgaagugcacccucaaguccuucaccguggagaaggggaucuaccagaccagcaacuuccgggugcagcccacggaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgcuaccggcuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgcgacaucgccgacaccaccgacgcgguccgggacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcgcguguacuccacggggagcaacgucuuccagacccgggccggcugccugaucggggcggagcacgugaacaacuccuacgagugcgacauccccaucggcgccggcaucugcgccagcuaccagacccagaccaacucccgccggcgcgcccggagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgcgcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgguucaacgggaucggcgucacgcagaacgugcuguacgagaaccagaagcucaucgccaaccaguucaacagcgccaucgggaagauccaggacucccugagcuccaccgccagcgcgcugggcaagcuccagaacguggucaaccagaacgcccaggcccugaacacccuggugaagcagcucuccagcaacuucggggccaucuccagcgugcugaacgacauccugucccgccucgacccgcccgaggccgagguccagaucgaccggcugaucaccggccgccugcagagccuccagacguacgugacccagcagcugauccgggcggccgagauccgcgccagcgccaaccuggccgcgaccaagauguccgagugcgugcucggccagagcaagcgggucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccuga

SEQ ID NO: 27142 - RNA, 3801 nt, Artificial Sequence
  SARS-CoV-2/Wuhan/WIV05/2019__EPI_ISL_402128 spike protein CDS gc (1-1273)(K986P_V987P_G75V_T76I_R246del_S247del_Y248del_L249del_T2 50del_P251del_G252del_L452Q_F490S_D614G_T859N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacgugaucaagcgguucgacaacccgguccugcccuucaacgacggcguguacuucgcgagcaccgagaaguccaacaucauccgcggguggaucuucggcaccacgcucgacagcaagacccagucccugcugaucgugaacaacgccaccaacgucgugaucaaggugugcgaguuccaguucugcaacgaccccuuccucggggucuacuaccacaagaacaacaagagcuggauggaguccgaguuccggguguacagcuccgccaacaacugcaccuucgaguacgugagccagcccuuccugauggaccuggagggcaagcagggcaacuucaagaaccuccgcgaguucgucuucaagaacaucgacggguacuucaagaucuacuccaagcacacgccgaucaaccuggugcgggaccugccccagggcuucagcgcccucgagccccugguggaccugcccaucgggaucaacaucacccgcuuccagacccuccuggcccugcacgacuccagcagcggcuggaccgcgggggccgccgccuacuacgucggcuaccuccagccgcggacguuccugcugaaguacaacgagaacggcaccaucaccgacgcgguggacugcgcccucgacccccuguccgagaccaagugcacgcucaagagcuucaccguggagaaggggaucuaccagaccuccaacuuccgcguccagcccaccgagagcaucgugcgguuccccaacaucacgaaccucugcccguucggcgaggucuucaacgccacccgcuucgccuccguguacgccuggaaccggaagcgcaucagcaacugcguggcggacuacuccguccuguacaacagcgccuccuucagcaccuucaagugcuacggggugucccccaccaagcugaacgaccucugcuucacgaacguguacgccgacagcuucgucauccggggcgacgaggugcgccagaucgcccccggccagaccgggaagaucgccgacuacaacuacaagcugcccgacgacuucaccggcugcgugaucgcguggaacuccaacaaccuggacagcaaggucgggggcaacuacaacuaccaguaccggcuguuccgcaaguccaaccugaagccguucgagcgggacaucagcaccgagaucuaccaggccggguccacgcccugcaacggcguggagggcuucaacugcuacagcccccugcaguccuacggguuccagcccaccaacggcgugggguaccagccguaccgcgucguggugcucagcuucgagcugcugcacgcccccgccaccgucugcggccccaagaaguccaccaaccucgugaagaacaagugcgugaacuucaacuucaacgggcugacgggcaccggcguccugaccgaguccaacaagaaguuccuccccuuccagcaguucgggcgggacaucgccgacaccaccgacgcggugcgcgacccgcagacgcuggagauccuggacaucacccccugcagcuucggcgggguguccgucaucacccccggcaccaacacgagcaaccagguggccgugcuguaccagggggucaacugcaccgaggugccgguggccauccacgccgaccagcucacccccaccuggcgcgucuacuccacgggcagcaacguguuccagacccgggccggcugccugaucggggcggagcacgugaacaacuccuacgagugcgacauccccaucggcgccgggaucugcgccagcuaccagacccagaccaacagcccccgccgggcccgcagcgucgcgucccagagcaucaucgccuacacgaugucccugggcgccgagaacagcguggccuacuccaacaacagcaucgccaucccgaccaacuucaccaucuccgugaccacggagauccuccccgucagcaugaccaagaccagcguggacugcaccauguacaucugcggcgacuccacggagugcagcaaccugcugcuccaguacggguccuucugcacccagcugaaccgggcgcugaccggcaucgccguggagcaggacaagaacacccaggaggucuucgcccaggugaagcagaucuacaagacgccgcccaucaaggacuucgggggcuucaacuucagccagauccuccccgaccccuccaagcccagcaagcgcuccuucaucgaggaccugcuguucaacaaggugacccucgccgacgccggguucaucaagcaguacggcgacugccugggcgacaucgcggcccgggaccugaucugcgcccagaaguucaacgggcucaacguccugcccccgcugcucaccgacgagaugaucgcccaguacaccagcgcccugcuggcgggcacgaucaccuccggguggaccuucggcgccggggccgcccuccagauccccuucgcgaugcagauggccuaccgcuucaacggcaucggcgugacccagaacgugcuguacgagaaccagaagcugaucgccaaccaguucaacagcgccaucgggaagauccaggacucccucagcuccacggccagcgcgcugggcaagcugcaggacgucgugaaccagaacgcccaggcccucaacacccuggugaagcagcuguccagcaacuucggggccaucuccagcguccucaacgacauccugucccggcuggacccgcccgaggccgaggugcagaucgaccgccucaucaccggccggcugcagagccugcagaccuacgugacgcagcagcucauccgcgcggccgagauccgggccagcgccaaccuggccgcgaccaagauguccgagugcguccuggggcagagcaagcgcguggacuucugcggcaagggcuaccaccucauguccuucccccagagcgcgccccacgggguggucuuccugcacgugaccuacguccccgcccaggagaagaacuucaccaccgcccccgccaucugccacgacggcaaggcccacuucccgcgggaggggguguucguguccaacggcacgcacugguucgucacccagcgcaacuucuacgagccccagaucaucaccaccgacaacacguucgugagcgggaacugcgacguggucaucggcaucgugaacaacaccguguacgacccccugcagcccgagcucgacuccuucaaggaggagcuggacaaguacuucaagaaccacaccagcccggacgucgaccugggcgacaucuccgggaucaacgccagcguggugaacauccagaaggagaucgaccggcucaacgaggucgccaagaaccugaacgagucccugaucgaccuccaggagcugggcaaguacgagcaguacaucaaguggcccugguacaucuggcugggguucaucgccggccucaucgcgaucgugauggugaccaucaugcugugcugcaugacgagcugcugcuccugccugaagggcugcugcagcugcggguccugcugcaaguucgacgaggacgacagcgagcccguccucaagggcgugaagcugcacuacaccuga

SEQ ID NO: 27143 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_N439K_D614G)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacguga

SEQ ID NO: 27144 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_E484K_D614G_A701V)
auguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggagcacccccugcaacggcgucaagggguucaacugcuacuucccccuccaguccuacggcuuccagccgaccaacggggugggcuaccagcccuaccggguggucgugcugagcuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcguguccgugaucaccccgggcacgaacaccagcaaccaggucgccgugcucuaccagggggugaacugcaccgagguccccguggccauccacgccgaccagcugacccccacguggcggguguacuccaccggcagcaacgucuuccagacccgcgccgggugccugaucggcgcggagcacgugaacaacuccuacgagugcgacauccccaucggcgccgggaucugcgccagcuaccagacccagacgaacuccccgcggcgcgcccggagcguggcgucccagagcaucaucgccuacaccaugucccucggcgucgagaacagcguggccuacuccaacaacagcaucgccauccccaccaacuucaccaucuccgugacgaccgagauccugcccgucagcaugaccaagaccagcguggacugcacgauguacaucugcggggacuccaccgagugcagcaaccugcuccugcaguacggcuccuucugcacccagcugaaccgcgcccucaccgggaucgcgguggagcaggacaagaacacgcaggaggucuucgcccaggugaagcagaucuacaagacgcccccgaucaaggacuucggcggcuucaacuucagccagauccugcccgaccccuccaagcccagcaagcgguccuucaucgaggaccuccuguucaacaaggugacccuggccgacgccggguucaucaagcaguacggcgacugccugggggacaucgccgcgcgcgaccucaucugcgcccagaaguucaacggccugaccguccugccgccccuccugaccgacgagaugaucgcccaguacaccagcgcccugcucgccgggaccaucaccuccggcuggacguucggcgcgggggccgcccugcagauccccuucgccaugcagauggcguaccgguucaacggcaucggggugacccagaacgugcuguacgagaaccagaagcucaucgccaaccaguucaacagcgccaucggcaagauccaggacucccugagcuccaccgccagcgcccuggggaagcuccaggacgucgugaaccagaacgcgcaggcccugaacacccuggugaagcagcucuccagcaacuucggcgccaucuccagcguccugaacgacauccugucccgccucgacccgccggaggccgaggugcagaucgaccggcugaucacgggccgccugcagagccuccagaccuacgugacccagcagcugauccgggccgcggagauccgcgccagcgccaaccuggccgccaccaagauguccgagugcguccucgggcagagcaagcggguggacuucugcggcaagggguaccaccugauguccuucccccagagcgcgccccacggcguggucuuccugcacgugaccuacguccccgcccaggagaagaacuucacgaccgccccggccaucugccacgacgggaaggcgcacuucccccgcgagggcguguucguguccaacggcacccacugguucgucacccagcggaacuucuacgagccccagaucaucacgaccgacaacaccuucgugagcgggaacugcgacguggucaucggcaucgugaacaacaccguguacgacccccuccagccggagcuggacuccuucaaggaggagcuggacaaguacuucaagaaccacacgagccccgacgucgaccucggggacaucuccggcaucaacgccagcguggugaacauccagaaggagaucgaccgccugaacgaggucgccaagaaccugaacgagucccucaucgaccugcaggagcugggcaaguacgagcaguacaucaaguggcccugguacaucuggcucggguucaucgccggccugaucgccaucgugauggugaccaucaugcugugcugcaugaccagcugcugcuccugccucaaggggugcugcagcugcggcuccugcugcaaguucgacgaggacgacagcgagccgguccugaagggggugaagcugcacuacaccuga

SEQ ID NO: 27145 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_S477N_D614G_Q957R)
auguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccucauggaccuggagggcaagcaggggaacuucaagaaccugcgcgaguucguguucaagaacaucgacggcuacuucaagaucuacuccaagcacacgccgaucaaccucguccgggaccugccccagggguucagcgcccuggagccccucguggaccugcccaucggcaucaacaucacccgcuuccagacccugcucgcccugcaccgguccuaccugacccccgggggcagcagcuccggcuggacggcgggggccgccgccuacuacgugggcuaccuccagccccgcaccuuccugcugaaguacaacgagaacgggaccaucaccgacgcggucgacugcgcccucgacccccugagcgagacgaagugcacccugaaguccuucaccguggagaagggcaucuaccagaccagcaacuuccgggugcagcccacggaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccaccuucaagugcuacggggucagccccacgaagcugaacgaccucugcuucaccaacguguacgccgacuccuucgugauccgcggcgacgagguccggcagaucgcccccgggcagaccggcaagaucgccgacuacaacuacaagcugccggacgacuucaccgggugcgugaucgcguggaacagcaacaaccuggacuccaaggugggcggcaacuacaacuaccucuaccgccuguuccgcaagagcaaccugaagcccuucgagcgggacaucuccacggagaucuaccaggccgggaacacccccugcaacggcgucgagggguucaacugcuacuucccccuccagagcuacggcuuccagccgaccaacggggugggcuaccagcccuaccggguggucgugcuguccuucgagcugcuccacgcccccgccaccgugugcggccccaagaaguccacgaaccuggucaagaacaagugcgugaacuucaacuucaacgggcugaccggcaccggggugcucaccgagagcaacaagaaguuccugccguuccagcaguucggccgcgacaucgccgacaccacggacgcgguccgcgacccccagacccuggagauccuggacaucacccccugcagcuucgggggcgugagcgugaucaccccgggcacgaacaccuccaaccaggucgccgugcucuaccagggggugaacugcaccgagguccccguggccauccacgccgaccagcugacccccacguggcggguguacagcaccggcuccaacgucuuccagacccgcgccgggugccugaucggcgcggagcacgugaacaacagcuacgagugcgacauccccaucggcgccgggaucugcgccuccuaccagacccagacgaacagcccgcggcgcgcccgguccguggcgagccaguccaucaucgccuacaccaugagccucggcgccgagaacuccgucgccuacagcaacaacuccaucgccauccccaccaacuucaccaucagcgugacgaccgagauccugcccguguccaugaccaagaccagcgucgacugcacgauguacaucugcggggacagcaccgagugcuccaaccugcuccugcaguacggcagcuucugcacccagcugaaccgcgcgcucaccgggaucgccguggagcaggacaagaacacgcaggagguguucgcccaggucaagcagaucuacaagacgcccccgaucaaggacuucggcggcuucaacuucucccagauccugcccgaccccagcaagcccuccaagcggagcuucaucgaggaccuccuguucaacaaggugacccuggccgacgccggguucaucaagcaguacggcgacugccugggggacaucgcggcccgcgaccucaucugcgcccagaaguucaacggccugaccgugcugccgccccuccugaccgacgagaugaucgcccaguacaccuccgcccugcucgcggggaccaucaccagcggcuggacguucggcgccggggccgcccugcagauccccuucgcgaugcagauggccuaccgguucaacggcaucggggucacccagaacgugcuguacgagaaccagaagcucaucgccaaccaguucaacuccgccaucggcaagauccaggacagccuguccagcaccgccuccgcgcuggggaagcuccaggacguggucaaccagaacgcccgcgcccugaacacccuggugaagcagcucagcuccaacuucggcgccaucagcuccgugcugaacgacauccugagccggcucgacccgccggaggccgagguccagaucgaccgccugaucacgggccggcugcagucccuccagaccuacgugacccagcagcugauccgcgcggccgagauccgggccagcgccaaccuggccgcgaccaagaugagcgagugcgugcucgggcaguccaagcgcgucgacuucugcggcaagggguaccaccugaugagcuucccccaguccgcgccccacggcgugguguuccugcacgucaccuacgugcccgcccaggagaagaacuucacgaccgccccggccaucugccacgacgggaaggcccacuucccccgggagggcgucuucgugagcaacggcacccacugguucgugacccagcgcaacuucuacgagccccagaucaucacgaccgacaacaccuucgucuccgggaacugcgacguggugaucggcaucgucaacaacaccguguacgacccccuccagccggagcuggacagcuucaaggaggagcuggacaaguacuucaagaaccacacgucccccgacguggaccucggggacaucagcggcaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggguucaucgccggccugaucgcgaucgucauggugaccaucaugcugugcugcaugaccuccugcugcagcugccucaaggggugcugcuccugcggcagcugcugcaaguucgacgaggacgacuccgagccggugcugaagggggucaagcugcacuacaccuga

SEQ ID NO: 27146 - RNA, 3822 nt, Artificial Sequence
  SARS-CoV-2/Wuhan/WIV05/2019__EPI_ISL_402128 spike protein CDS gc (1-1273)(K986P_V987P_F157L_V367F_Q613H_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccucuacaacuccgccagcuucuccacguucaagugcuacggcgugagccccaccaagcugaacgaccugugcuucaccaacgucuacgccgacuccuucgugauccgcggggacgaggugcggcagaucgcccccggccagaccgggaagaucgccgacuacaacuacaagcucccggacgacuucacgggcugcgucaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccucagcuucgagcugcugcacgcccccgccacggugugcggccccaagaaguccaccaaccucgugaagaacaagugcgucaacuucaacuucaacggccugaccgggaccggcgugcugaccgagagcaacaagaaguuccugccguuccagcaguucgggcgcgacaucgccgacacgaccgacgcggugcgcgacccccagacccucgagauccuggacaucacccccugcagcuucggcggggucuccgugaucacgccgggcaccaacaccagcaaccagguggccguccuguaccacgacgugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacucccggcgccgggcccgcagcguggcgucccagagcaucaucgccuacaccaugucccugggcgccgagaacagcguggccuacuccaacaacagcaucgccaucccgaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgggcgcugacggggaucgccgucgagcaggacaagaacacccaggagguguucgcccaggugaagcagaucuacaagaccccgcccaucaaggacuucggcggguucaacuucagccagauccuccccgaccccuccaagcccagcaagcgcuccuucaucgaggaccugcuguucaacaaggucacccucgccgacgccggcuucaucaagcaguacggcgacugccugggggacaucgcggcccgggaccugaucugcgcccagaaguucaacggccucacggugcugcccccgcugcucaccgacgagaugaucgcccaguacaccagcgcccugcuggcggggaccaucacguccggcuggaccuucggggccggcgccgcccuccagauccccuucgcgaugcagauggccuaccgcuucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccggcuggacccgcccgaggccgaggugcagaucgaccgccucaucaccgggcggcugcagagccugcagaccuacgucacccagcagcucauccgcgcggccgagauccgggccagcgccaaccuggccgcgaccaagauguccgagugcgugcugggccagagcaagcgcguggacuucugcggcaagggguaccaccucauguccuucccccagagcgcgccccacggcgucguguuccugcacgugacguacguccccgcccaggagaagaacuucaccaccgcccccgccaucugccacgacgggaaggcccacuucccgcgggagggcguguucgucuccaacgggacccacugguucgugacgcagcgcaacuucuacgagccccagaucaucaccaccgacaacaccuucgugagcggcaacugcgacgucgugaucggcaucgugaacaacacggucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggcccugguacaucuggcugggcuucaucgccggccucaucgcgaucgugauggucaccaucaugcugugcugcaugaccagcugcugcuccugccugaaggggugcugcagcugcggcuccugcugcaaguucgacgaggacgacagcgagcccgugcucaagggggugaagcugcacuacacguga

SEQ ID NO: 27147 - RNA, 3822 nt, Artificial Sequence
  SARS-CoV-2/Wuhan/WIV05/2019__EPI_ISL_402128 spike protein CDS gc (1-1273)(K986P_V987P_S254F_D614G_P681R_G769V)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacuucagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagccggcgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgggcgcugacggugaucgccguggagcaggacaagaacacccaggaggucuucgcccaggugaagcagaucuacaagaccccgcccaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugacgguccugcccccgcuccugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggugacccagaacgugcucuacgagaaccagaagcugaucgccaaccaguucaacuccgccaucggcaagauccaggacagccuguccagcaccgccuccgcgcucgggaagcugcaggacgucgugaaccagaacgcccaggcccugaacacgcucgugaagcagcugagcuccaacuucggcgccaucagcuccguccugaacgacauccucagccggcuggacccgcccgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgcgccccacggcguggucuuccuccacgugacguacguccccgcccaggagaagaacuucaccaccgcccccgccaucugccacgacgggaaggcccacuucccgcgggagggcguguucgugagcaacgggacccacugguucgucacgcagcgcaacuucuacgagccccagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccuccccggacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacguga

SEQ ID NO: 27148 - RNA, 3804 nt, Artificial Sequence
  SARS-CoV-2/Wuhan/WIV05/2019__EPI_ISL_402128 spike protein CDS gc (1-1273)(K986P_V987P_P26S_H69del_V70del_V126A_Y144del_L242del_A24 3del_L244del_H245Y_S477N_E484K_D614G_P681H_T1027I_D1118H)
auguucguguuccugguccuccugccccuggugagcucccagugcgugaaccucaccacccgcacgcagcugccgagcgccuacaccaacuccuucacccggggcgucuacuaccccgacaagguguuccgcagcuccgugcugcacagcacccaggaccucuuccugcccuucuucuccaacgucacgugguuccacgccaucagcgggaccaacggcaccaagcgguucgacaaccccgugcugccguucaacgacgggguguacuucgcguccaccgagaaguccaacaucauccgcggcuggaucuucgggacgacccucgacagcaagacccagagccugcugaucgucaacaacgccaccaacgccgugaucaaggugugcgaguuccaguucugcaacgaccccuuccucggcgucuaccacaagaacaacaaguccuggauggagagcgaguuccggguguacuccagcgccaacaacugcacguucgaguacgugucccagcccuuccugauggaccuggagggcaagcaggggaacuucaagaaccuccgcgaguucgucuucaagaacaucgacggcuacuucaagaucuacagcaagcacacccccaucaaccuggugcgggaccugccgcagggguucuccgcccucgagccccugguggaccugcccaucggcaucaacaucacccgcuuccagacccucuaccggagcuaccugacgcccggggacagcuccagcggcuggaccgcgggcgccgccgccuacuacgucggguaccugcagccgcgcaccuuccuccugaaguacaacgagaacggcaccaucacggacgcgguggacugcgcccuggacccccucuccgagaccaagugcacccucaagagcuucaccguggagaaggggaucuaccagacguccaacuuccggguccagcccaccgagagcaucgugcgcuuccccaacaucaccaaccugugcccguucggcgagguguucaacgccacccgguucgccuccgucuacgccuggaaccgcaagcggaucagcaacugcguggcggacuacuccguccuguacaacagcgccuccuucagcacguucaagugcuacggcgugucccccaccaagcugaacgaccugugcuucaccaacguguacgccgacagcuucgucauccgcggggacgaggugcggcagaucgcccccggccagaccgggaagaucgccgacuacaacuacaagcuccccgacgacuucacgggcugcgugaucgcguggaacuccaacaaccuggacagcaaggucgggggcaacuacaacuaccuguaccgccucuuccggaaguccaaccugaagccguucgagcgcgacaucagcaccgagaucuaccaggccggcaacacccccugcaacggggugaagggcuucaacugcuacuucccccugcaguccuacggguuccagcccaccaacggcgugggguaccagccguaccgggucguggugcucagcuucgagcugcugcacgcccccgccacggucugcggccccaagaaguccaccaaccucgugaagaacaagugcgugaacuucaacuucaacggccugaccgggaccggcguccugaccgagagcaacaagaaguuccuccccuuccagcaguucgggcgcgacaucgccgacacgaccgacgcggugcgcgacccgcagacccuggagauccuggacaucacccccugcagcuucggcgggguguccgucaucacgcccggcaccaacaccagcaaccagguggccgugcuguaccagggcgucaacugcaccgaggugccgguggccauccacgccgaccagcucacgcccaccuggcgggucuacuccaccgggagcaacguguuccagacccgcgccggcugccugaucggggcggagcacgugaacaacuccuacgagugcgacauccccaucggcgccggcaucugcgccagcuaccagacgcagaccaacucccaccggcgcgcccggagcgucgcgucccagagcaucaucgccuacaccaugucccugggggccgagaacagcguggccuacuccaacaacagcaucgccauccccaccaacuucacgaucuccgugaccaccgagauccucccggucagcaugaccaagacgagcguggacugcaccauguacaucugcggcgacuccaccgagugcagcaaccugcugcuccaguacggguccuucugcacccagcugaaccgcgcgcugacgggcaucgccguggagcaggacaagaacacccaggaggucuucgcccaggugaagcagaucuacaagaccccgcccaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucacgguccugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacgugcuguacgagaaccagaagcugaucgccaaccaguucaacagcgccaucgggaagauccaggacucccucagcuccaccgccagcgcgcugggcaagcugcaggacgucgugaaccagaacgcccaggcccucaacacgcuggugaagcagcuguccagcaacuucggggccaucuccagcguccucaacgacauccugucccgccuggacccgcccgaggccgaggugcagaucgaccggcucaucaccggccgccugcagagccugcagaccuacgugacccagcagcucauccgggcggccgagauccgcgccagcgccaaccuggccgcgaucaagauguccgagugcguccugggccagagcaagcggguggacuucugcgggaagggcuaccaccucauguccuucccccagagcgcgccccacgggguggucuuccugcacgugaccuacgugcccgcccaggagaagaacuucacgaccgcccccgccaucugccacgacggcaaggcccacuucccccgcgagggggucuucguguccaacggcacccacugguucgucacccagcggaacuucuacgagccgcagaucaucacgacccacaacaccuucgugagcggcaacugcgacguggucaucgggaucgugaacaacaccguguacgacccccugcagcccgagcucgacuccuucaaggaggagcuggacaaguacuucaagaaccacacgagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacaccuga

SEQ ID NO: 27149 - RNA, 3825 nt, Artificial Sequence
  SARS-CoV-2/Wuhan/WIV05/2019__EPI_ISL_402128 spike protein CDS gc (1-1273)(K986P_V987P_T95I_Y144T_Y145S_ins145N_R346K_E484K_N501Y_D 614G_P681H_D950N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaucgagaaguccaacaucauccgcggcuggaucuucgggaccacgcucgacagcaagacccagucccugcugaucgugaacaacgccaccaacguggucaucaaggugugcgaguuccaguucugcaacgaccccuuccucggcgugaccagcaaccacaagaacaacaaguccuggauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacagcuccagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccaccaaguucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacggggugaagggcuucaacugcuacuucccccugcagagcuacggguuccagccgaccuacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcuccuucggcggggugagcgugaucacgccgggcaccaacaccuccaaccaggucgccgugcuguaccagggcgugaacugcaccgagguccccguggccauccacgccgaccagcugacgcccaccuggcgcguguacagcaccggguccaacgucuuccagacccgggccggcugccucaucggggcggagcacgugaacaacagcuacgagugcgacauccccaucggcgccggcaucugcgccuccuaccagacgcagaccaacagccaccgccgggcccgcuccguggcgagccaguccaucaucgccuacaccaugagccugggggccgagaacuccgucgccuacagcaacaacuccaucgccaucccgaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgggcgcugacgggcaucgccguggagcaggacaagaacacccaggagguguucgcccaggucaagcagaucuacaagaccccgcccaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccucggcgacaucgcggcccgggaccugaucugcgcccagaaguucaacgggcugacggugcugcccccgcuccugaccgacgagaugaucgcccaguacaccuccgcccuccuggcgggcaccaucacgagcggguggaccuucggcgccggcgccgcccugcagauccccuucgcgaugcagauggccuaccgcuucaacgggaucggcgucacccagaacgugcucuacgagaaccagaagcugaucgccaaccaguucaacuccgccaucgggaagauccaggacagccuguccagcaccgccuccgcgcucggcaagcugcagaacguggucaaccagaacgcccaggcccugaacacgcucgugaagcagcugagcuccaacuucggggccaucagcuccgugcugaacgacauccucagccggcuggacccgcccgaggccgagguccagaucgaccgccugaucaccggccggcuccagagccugcagaccuacgugacccagcagcugauccgcgcggccgagauccgggccuccgccaaccucgccgcgaccaagaugagcgagugcgugcugggccaguccaagcgcgucgacuucugcgggaagggcuaccaccugaugagcuucccccaguccgcgccccacggggugguguuccuccacgucacguacgugcccgcccaggagaagaacuucaccaccgcccccgccaucugccacgacggcaaggcccacuucccgcgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccugcagcccgagcuggacagcuucaaggaggagcucgacaaguacuucaagaaccacaccuccccggacguggaccugggcgacaucagcgggaucaacgccuccgucgugaacauccagaaggagaucgaccggcugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagcccgugcugaagggcgucaagcuccacuacacguga

SEQ ID NO: 27150 - RNA, 3831 nt, Artificial Sequence
  SARS-CoV-2/Wuhan/WIV05/2019__EPI_ISL_402128 spike protein CDS gc (1-1273)(K986P_V987P_ins214TDR_Q414K_N450K_D614G_T716I)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggaccgaccgcgaccugccccagggguucagcgcccucgagccccugguggaccugcccaucggcaucaacaucacccgguuccagacgcuccuggcccugcaccgcuccuaccucaccccgggggacagcagcuccggcuggaccgcgggcgccgccgccuacuacgugggguaccugcagccccggaccuuccugcucaaguacaacgagaacggcacgaucaccgacgcggucgacugcgcccuggacccccugagcgagaccaagugcacccucaaguccuucacgguggagaaggggaucuaccagaccagcaacuuccgcgugcagcccaccgaguccaucguccgguucccgaacaucaccaaccugugccccuucggcgagguguucaacgccacgcgcuucgccagcgucuacgccuggaaccggaagcgcaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggcaagacggggaagaucgccgacuacaacuacaagcugccggacgacuucaccggcugcgugaucgcguggaacagcaacaaccucgacuccaaggucgggggcaacuacaaguaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccgcguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgggacccccagacccuggagauccucgacaucacgcccugcagcuucggcgggguguccgugaucaccccgggcaccaacaccagcaaccaggucgccgugcuguaccagggcgugaacugcacggagguccccguggccauccacgccgaccagcugacccccaccuggcgcguguacuccaccgggagcaacgucuuccagacgcgggccggcugccucaucggggcggagcacgugaacaacuccuacgagugcgacauccccaucggcgccggcaucugcgccagcuaccagacccagaccaacuccccgcgccgggcccgcagcguggcgucccagagcaucaucgccuacaccaugucccugggggccgagaacagcgucgccuacuccaacaacagcaucgccauccccaucaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccggcuggacccgcccgaggccgagguccagaucgaccgccugaucaccggccggcuccagagccugcagaccuacgugacccagcagcugauccgcgcggccgagauccgggccagcgccaaccucgccgcgaccaagauguccgagugcgugcugggccagagcaagcgcgucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgggagggggucuucguguccaacggcacccacugguucgugacgcagcgcaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccggcugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacguga

SEQ ID NO: 27151 - RNA, 3822 nt, Artificial Sequence
  SARS-CoV-2/Wuhan/WIV05/2019__EPI_ISL_402128 spike protein CDS gc (1-1273)(K986P_V987P_T478K_D614G_P681H_T732A)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcaagcccugcaacgggguggagggcuucaacugcuacuucccccugcaguccuacggguuccagccgaccaacggcgugggguaccagcccuaccggguggucgugcugagcuucgagcuccugcacgcccccgccaccgugugcggccccaagaaguccacgaaccuggucaagaacaagugcgugaacuucaacuucaacggccucaccgggaccggcgugcugaccgagagcaacaagaaguuccugccguuccagcaguucgggcgcgacaucgccgacaccacggacgcgguccgcgacccccagacccuggagauccucgacaucacccccugcagcuucggcgggguguccgugaucaccccgggcacgaacaccagcaaccaggucgccgugcuguaccagggcgugaacugcaccgagguccccguggccauccacgccgaccagcugacccccacguggcggguguacuccaccgggagcaacgucuuccagacccgcgccggcugccucaucggggcggagcacgugaacaacuccuacgagugcgacauccccaucggcgccggcaucugcgccagcuaccagacccagacgaacucccaccggcgcgcccggagcguggcgucccagagcaucaucgccuacaccaugucccugggggccgagaacagcgucgccuacuccaacaacagcaucgccaucccgaccaacuucaccaucuccgugacgaccgagauccugcccgugagcauggcgaagaccagcgucgacugcaccauguacaucugcggcgacuccacggagugcagcaaccuccugcugcaguacggguccuucugcacccagcucaaccgcgcccugaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgguccuucaucgaggaccuccuguucaacaaggugacccuggccgacgcgggcuucaucaagcaguacggggacugccucggcgacaucgccgcccgcgaccugaucugcgcccagaaguucaacgggcugaccgugcugcccccgcuccugaccgacgagaugaucgcccaguacacgagcgcgcuccuggccggcaccaucaccuccggguggaccuucggcgccggcgccgcgcugcagauccccuucgccaugcagauggccuaccgguucaacgggaucggcgucacgcagaacgugcucuacgagaaccagaagcugaucgccaaccaguucaacagcgccaucgggaagauccaggacucccugagcuccaccgcgagcgcccucggcaagcugcaggacguggucaaccagaacgcccaggcccugaacacccucgugaagcagcuguccagcaacuucggggccaucuccagcgugcugaacgacauccucucccgccuggacccgcccgaggcggagguccagaucgaccggcugaucaccggccgccuccagagccugcagacguacgugacccagcagcugauccgggccgccgagauccgcgccagcgccaaccucgcggccaccaagauguccgagugcgugcugggccagagcaagcgggucgacuucugcgggaagggcuaccaccugauguccuucccccagagcgcgccccacggggugguguuccuccacgucaccuacgugcccgcccaggagaagaacuucaccacggcccccgccaucugccacgacggcaaggcccacuucccgcgcgagggggucuucguguccaacggcacccacugguucgugacccagcggaacuucuacgagccccagaucaucaccacggacaacaccuucgucagcggcaacugcgacguggugaucgggaucgucaacaacaccguguacgacccccugcagcccgagcuggacuccuucaaggaggagcucgacaaguacuucaagaaccacaccagcccggacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgcggggcugaucgccaucgucauggugacgaucaugcucugcugcaugaccagcugcugcuccugccugaagggcugcugcagcugcggguccugcugcaaguucgacgaggacgacagcgagcccgugcugaagggcgucaagcuccacuacaccuga

SEQ ID NO: 27152 - RNA, 3822 nt, Artificial Sequence
  SARS-CoV-2/Wuhan/WIV05/2019__EPI_ISL_402128 spike protein CDS gc (1-1273)(K986P_V987P_E484K_N501Y_D614G_P681H_E1092K_H1101Y_V1176F )
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacucccaccggcgcgcccggagcguggcgucccagagcaucaucgccuacaccaugucccugggggccgagaacagcgucgccuacuccaacaacagcaucgccaucccgaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugacggugcugcccccgcuccugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgcccccgccaucugccacgacggcaaggcccacuucccgcgcaagggggucuucguguccaacggcaccuacugguucgugacgcagcggaacuucuacgagccccagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagcccggacguggaccugggcgacaucuccgggaucaacgccagcuucgucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 27153 - RNA, 3816 nt, Artificial Sequence
  SARS-CoV-2/Wuhan/WIV05/2019__EPI_ISL_402128 spike protein CDS gc (1-1273)(K986P_V987P_H66D_G142V_Y144del_Y145del_D215G_V483A_D614G _H655Y_G669S_Q949R_N1187D)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguucgacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucgugguccacaagaacaacaagagcuggauggaguccgaguuccggguguacagcuccgccaacaacugcacguucgaguacgugagccagcccuuccugauggaccuggagggcaagcagggcaacuucaagaaccuccgcgaguucgucuucaagaacaucgacggguacuucaagaucuacuccaagcacaccccgaucaaccuggugcggggccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgcggacacgaccgacgccguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgcgggcugccucaucggggccgaguacgugaacaacuccuacgagugcgacauccccaucggcgccagcaucugcgccuccuaccagacgcagaccaacagcccgcggcgcgcgcgguccguggccagccaguccaucaucgccuacaccaugagccugggcgccgagaacuccgucgccuacagcaacaacuccaucgcgauccccaccaacuucacgaucagcgugaccaccgagauccugcccgugagcaugaccaagacguccgucgacugcaccauguacaucugcggggacagcaccgagugcuccaaccuccugcugcaguacggcagcuucugcacccagcucaaccgcgcccugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccuccgcgcuccuggccgggaccaucacgagcggcuggaccuucggggccggcgccgcgcugcagauccccuucgccaugcagauggccuaccgguucaacggcaucggggucacccagaacgugcucuacgagaaccagaagcugaucgccaaccaguucaacuccgccaucggcaagauccaggacagccuguccagcaccgcguccgcccucgggaagcugcgcgacguggucaaccagaacgcccaggcccugaacacgcucgugaagcagcugagcuccaacuucggcgccaucagcuccgugcugaacgacauccucagccggcuggacccgcccgaggcggagguccagaucgaccgccugaucaccgggcggcuccagagccugcagaccuacgugacccagcagcugauccgcgccgccgagauccgggccuccgccaaccucgcggccaccaagaugagcgagugcgugcugggccaguccaagcgcgucgacuucugcggcaagggguaccaccugaugagcuucccccaguccgcgccccacggcgugguguuccuccacgucacguacgugcccgcccaggagaagaacuucaccaccgccccggccaucugccacgacgggaaggcccacuucccccgggagggcgucuucgugagcaacgggacccacugguucgugacgcagcgcaacuucuacgagccccagaucaucaccaccgacaacaccuucgucuccggcaacugcgacguggugaucggcaucgucaacaacacgguguacgacccccugcagccggagcuggacagcuucaaggaggagcucgacaaguacuucaagaaccacaccucccccgacguggaccugggggacaucagcggcaucaacgccuccgucgugaacauccagaaggagaucgaccggcuggacgagguggccaagaaccucaacgagagccugaucgaccugcaggagcucgggaaguacgagcaguacaucaaguggcccugguacaucuggcugggcuucaucgcgggccugaucgccaucgucauggugaccaucaugcucugcugcaugaccuccugcugcagcugccugaaggggugcugcuccugcggcagcugcugcaaguucgacgaggacgacuccgagccggugcugaagggggucaagcuccacuacacguga

SEQ ID NO: 27154 - RNA, 3819 nt, Artificial Sequence
  SARS-CoV-2/Wuhan/WIV05/2019__EPI_ISL_402128 spike protein CDS gc (1-1273)(K986P_V987P_Y144del_L452R_T478K_P681R)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccggcuguuccgcaagagcaaccugaagcccuucgagcgggacaucuccaccgagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccacgaaccuggucaagaacaagugcgugaacuucaacuucaacggccugaccgggaccggcgugcucaccgagagcaacaagaaguuccugccguuccagcaguucgggcgcgacaucgccgacaccacggacgcgguccgggacccccagacccuggagauccuggacaucacccccugcagcuucggcgggguguccgugaucaccccgggcacgaacaccagcaaccaggucgccgugcucuaccaggacgugaacugcaccgagguccccguggccauccacgccgaccagcugacccccacguggcgcguguacuccaccggcagcaacgucuuccagacccgggccgggugccugaucggcgcggagcacgugaacaacuccuacgagugcgacauccccaucggggccggcaucugcgccagcuaccagacccagacgaacucccgccggcgcgcccggagcguggcgucccagagcaucaucgccuacaccaugucccucggcgccgagaacagcgucgccuacuccaacaacagcaucgccaucccgaccaacuucaccaucuccgugacgaccgagauccugcccgugagcaugaccaagaccagcgucgacugcacgauguacaucugcggggacuccaccgagugcagcaaccugcuccugcaguacggcuccuucugcacccagcugaaccgcgcgcucaccgggaucgccguggagcaggacaagaacacgcaggagguguucgcccaggucaagcagaucuacaagaccccgcccaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugcccccgcuccugacggacgagaugaucgcccaguacaccagcgcccugcucgcggggaccaucaccuccggcuggacguucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacccuggugaagcagcucuccagcaacuucggcgccaucuccagcgugcugaacgacauccugucccgccucgacccgcccgaggccgagguccagaucgaccggcugaucacggggcgccugcagagccuccagaccuacgugacccagcagcugauccgggcggccgagauccgcgccagcgccaaccuggccgcgaccaagauguccgagugcgugcucggccagagcaagcgggucgacuucugcggcaagggguaccaccugauguccuucccccagagcgcgccccacggcgugguguuccugcacgucaccuacgugcccgcccaggagaagaacuucacgaccgcccccgccaucugccacgacgggaaggcccacuucccgcgcgagggcgucuucguguccaacgggacccacugguucgugacccagcggaacuucuacgagccccagaucaucacgaccgacaacaccuucgucagcggcaacugcgacguggugaucggcaucgucaacaacaccguguacgacccccuccagcccgagcuggacuccuucaaggaggagcuggacaaguacuucaagaaccacacgagcccggacguggaccucggggacaucuccggcaucaacgccagcgucgugaacauccagaaggagaucgaccgccugaacgagguggccaagaaccugaacgagucccucaucgaccugcaggagcuggggaaguacgagcaguacaucaaguggcccugguacaucuggcucggcuucaucgccggccugaucgcgaucgucauggugaccaucaugcugugcugcaugaccagcugcugcuccugccucaaggggugcugcagcugcggcuccugcugcaaguucgacgaggacgacagcgagcccgugcugaagggggucaagcugcacuacaccuga

SEQ ID NO: 27155 - RNA, 3816 nt, Artificial Sequence
  SARS-CoV-2/Wuhan/WIV05/2019__EPI_ISL_402128 spike protein CDS gc (1-1273)(K986P_V987P_T19R_Y144del_Y145del_L452R_T478K_D614G_P681R )
auguucguguuccugguccuccugccccuggugagcucccagugcgugaaccuccgcacccggacccagcugccgcccgccuacacgaacagcuucacccgcggcgucuacuaccccgacaagguguuccgguccagcgugcugcacuccacccaggaccucuuccugcccuucuucagcaacgucaccugguuccacgccauccacguguccgggacgaacggcaccaagcgcuucgacaacccggugcugcccuucaacgacggggucuacuucgcgagcaccgagaaguccaacaucauccggggcuggaucuucgggaccacgcucgacagcaagacccagucccugcugaucgugaacaacgccaccaacguggucaucaaggugugcgaguuccaguucugcaacgaccccuuccucggcgugcacaagaacaacaagagcuggauggaguccgaguuccgcgucuacagcuccgccaacaacugcaccuucgaguacgugagccagcccuuccugauggaccuggagggcaagcaggggaacuucaagaaccuccgggaguucguguucaagaacaucgacggcuacuucaagaucuacuccaagcacacgccgaucaaccugguccgcgaccugccccagggguucagcgcccucgagccccugguggaccugcccaucggcaucaacaucacccgguuccagacccuccuggcccugcaccgcuccuaccucaccccgggggacagcagcuccggcuggacggcgggcgccgccgccuacuacgugggguaccugcagccccggaccuuccugcucaaguacaacgagaacggcaccaucaccgacgcggucgacugcgcccuggacccccugagcgagacgaagugcacccucaaguccuucaccguggagaaggggaucuaccagaccagcaacuuccgcgugcagcccacggaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcucaacgaccugugcuucaccaacguguacgccgacuccuucgugauccgcggggacgagguccggcagaucgcccccggccagaccgggaagaucgccgacuacaacuacaagcugccggacgacuucaccggcugcgugaucgcguggaacagcaacaaccucgacuccaaggucgggggcaacuacaacuaccgguaccgccuguuccgcaagagcaaccugaagcccuucgagcgggacaucuccacggagaucuaccaggccggcagcaagcccugcaacgggguggagggcuucaacugcuacuucccccuccaguccuacggguuccagccgaccaacggcgugggguaccagcccuaccgcguggucgugcugagcuucgagcugcuccacgcccccgccaccgugugcggccccaagaaguccaccaaccuggucaagaacaagugcgugaacuucaacuucaacggccugacggggaccggcgugcucaccgagagcaacaagaaguuccugccguuccagcaguucgggcgggacaucgccgacaccaccgacgcgguccgcgacccccagacgcuggagauccuggacaucacccccugcagcuucggcgggguguccgugaucaccccgggcaccaacacgagcaaccaggucgccgugcucuaccagggcgugaacugcaccgagguccccguggccauccacgccgaccagcugacccccaccuggcggguguacuccacggggagcaacgucuuccagacccgcgccggcugccugaucggggcggagcacgugaacaacuccuacgagugcgacauccccaucggcgccggcaucugcgccagcuaccagacccagaccaacucccggcgccgggcccgcagcguggcgucccagagcaucaucgccuacacgaugucccucggggccgagaacagcgucgccuacuccaacaacagcaucgccaucccgaccaacuucaccaucuccgugaccacggagauccugcccgugagcaugaccaagaccagcgucgacugcaccauguacaucugcggcgacuccacggagugcagcaaccugcuccugcaguacggguccuucugcacccagcugaaccgggcgcucaccggcaucgccguggagcaggacaagaacacccaggagguguucgcccaggucaagcagaucuacaagacgccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugaccgugcugcccccgcuccugaccgacgagaugaucgcccaguacacgagcgcccugcucgcgggcaccaucaccuccggguggaccuucggcgccggcgccgcccugcagauccccuucgcgaugcagauggccuaccgcuucaacgggaucggcgucacgcagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacccuggugaagcagcucuccagcaacuucggggccaucuccagcgugcugaacgacauccugucccggcucgacccgcccgaggccgagguccagaucgaccgccugaucaccggccggcugcagagccuccagacguacgugacccagcagcugauccgcgcggccgagauccgggccagcgccaaccuggccgcgaccaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucaccacggcccccgccaucugccacgacggcaaggcccacuucccgcgggagggggucuucguguccaacggcacccacugguucgugacccagcgcaacuucuacgagccccagaucaucaccacggacaacaccuucgucagcggcaacugcgacguggugaucgggaucgucaacaacaccguguacgacccccuccagcccgagcuggacuccuucaaggaggagcuggacaaguacuucaagaaccacaccagcccggacguggaccucggcgacaucuccgggaucaacgccagcgucgugaacauccagaaggagaucgaccgccugaacgagguggccaagaaccugaacgagucccucaucgaccugcaggagcugggcaaguacgagcaguacaucaaguggcccugguacaucuggcucggcuucaucgccgggcugaucgcgaucgucauggugacgaucaugcugugcugcaugaccagcugcugcuccugccucaagggcugcugcagcugcggguccugcugcaaguucgacgaggacgacagcgagcccgugcugaagggcgucaagcugcacuacaccuga

SEQ ID NO: 27156 - RNA, 3813 nt, Artificial Sequence
  SARS-CoV-2/Wuhan/WIV05/2019__EPI_ISL_402128 spike protein CDS gc (1-1273)(K986P_V987P_H69del_V70del_Y144del_E484K_N501Y_A570D_D614 G_P681H_T716I_S982A_D1118H)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27157 - RNA, 3813 nt, Artificial Sequence
  SARS-CoV-2/Wuhan/WIV05/2019__EPI_ISL_402128 spike protein CDS gc (1-1273)(K986P_V987P_L18F_D80A_D215G_L242del_A243del_L244del_K417 N_E484K_N501Y_D614G_A701V)
auguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27158 - RNA, 3813 nt, Artificial Sequence
  SARS-CoV-2/Wuhan/WIV05/2019__EPI_ISL_402128 spike protein CDS gc (1-1273)(K986P_V987P_Q52R_A67V_H69del_V70del_Y144del_E484K_D614G_ Q677H_F888L)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccgcgaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27159 - RNA, 3813 nt, Artificial Sequence
  SARS-CoV-2/Wuhan/WIV05/2019__EPI_ISL_402128 spike protein CDS gc (1-1273)(K986P_V987P_A67V_H69del_V70del_Y144del_E484K_D614G_Q677H _F888L)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgugaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccacaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacucugggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27160 - RNA, 3822 nt, Artificial Sequence
  SARS-CoV-2/Wuhan/WIV05/2019__EPI_ISL_402128 spike protein CDS gc (1-1273)(K986P_V987P_L18F_T20N_P26S_D138Y_R190S_K417T_E484K_N501Y _D614G_H655Y_T1027I_V1176F)
auguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27161 - RNA, 3822 nt, Artificial Sequence
  SARS-CoV-2/Wuhan/WIV05/2019__EPI_ISL_402128 spike protein CDS gc (1-1273)(K986P_V987P_E484K_D614G_V1176F)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27162 - RNA, 3822 nt, Artificial Sequence
  SARS-CoV-2/Wuhan/WIV05/2019__EPI_ISL_402128 spike protein CDS gc (1-1273)(K986P_V987P_L452R_D614G_P681R)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27163 - RNA, 3822 nt, Artificial Sequence
  SARS-CoV-2/Wuhan/WIV05/2019__EPI_ISL_402128 spike protein CDS gc (1-1273)(K986P_V987P_E154K_L452R_E484Q_D614G_P681R_Q1071H)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggaugaagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcgugcagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccacgagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27164 - RNA, 3816 nt, Artificial Sequence
  SARS-CoV-2/Wuhan/WIV05/2019__EPI_ISL_402128 spike protein CDS gc (1-1273)(K986P_V987P_T19R_F157del_R158del_L452R_T478K_D614G_P681R _D950N)
auguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27165 - RNA, 3801 nt, Artificial Sequence
  SARS-CoV-2/Wuhan/WIV05/2019__EPI_ISL_402128 spike protein CDS gc (1-1273)(K986P_V987P_G75V_T76I_R246del_S247del_Y248del_L249del_T2 50del_P251del_G252del_L452Q_F490S_D614G_T859N)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacgugaucaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcacgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccaguaccggcuguuccggaagagcaaccugaagcccuucgagcgggacaucagcaccgagaucuaccaagccggcuccaccccuugcaacggcguggagggcuucaacugcuacagcccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaacgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27166 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_N439K_D614G)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27167 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_E484K_D614G_A701V)
auguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27168 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_S477N_D614G_Q957R)
auguucguguucuucgugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcggcagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccgcgcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27169 - RNA, 3822 nt, Artificial Sequence
  SARS-CoV-2/Wuhan/WIV05/2019__EPI_ISL_402128 spike protein CDS gc (1-1273)(K986P_V987P_F157L_V367F_Q613H_P681R)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgagcugcggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcuuccuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccacgacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27170 - RNA, 3822 nt, Artificial Sequence
  SARS-CoV-2/Wuhan/WIV05/2019__EPI_ISL_402128 spike protein CDS gc (1-1273)(K986P_V987P_S254F_D614G_P681R_G769V)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacuucagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccgugaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27171 - RNA, 3804 nt, Artificial Sequence
  SARS-CoV-2/Wuhan/WIV05/2019__EPI_ISL_402128 spike protein CDS gc (1-1273)(K986P_V987P_P26S_H69del_V70del_V126A_Y144del_L242del_A24 3del_L244del_H245Y_S477N_E484K_D614G_P681H_T1027I_D1118H)
auguucguguuccuggugcugcugccccuggugagcagccagugcgugaaccugaccacccggacccagcugccaagcgccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacgccgugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccuguaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27172 - RNA, 3825 nt, Artificial Sequence
  SARS-CoV-2/Wuhan/WIV05/2019__EPI_ISL_402128 spike protein CDS gc (1-1273)(K986P_V987P_T95I_Y144T_Y145S_ins145N_R346K_E484K_N501Y_D 614G_P681H_D950N)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaucgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugaccagcaaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccaccaaguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcagaacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27173 - RNA, 3831 nt, Artificial Sequence
  SARS-CoV-2/Wuhan/WIV05/2019__EPI_ISL_402128 spike protein CDS gc (1-1273)(K986P_V987P_ins214TDR_Q414K_N450K_D614G_T716I)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggaccgaccgcgaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggcaagacaggcaagaucgccgacuacaacuacaagcugcccgacgacuucaccggcugcgugaucgccuggaacagcaacaaccucgacagcaaggugggcggcaacuacaaguaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27174 - RNA, 3822 nt, Artificial Sequence
  SARS-CoV-2/Wuhan/WIV05/2019__EPI_ISL_402128 spike protein CDS gc (1-1273)(K986P_V987P_T478K_D614G_P681H_T732A)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcauggccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27175 - RNA, 3822 nt, Artificial Sequence
  SARS-CoV-2/Wuhan/WIV05/2019__EPI_ISL_402128 spike protein CDS gc (1-1273)(K986P_V987P_E484K_N501Y_D614G_P681H_E1092K_H1101Y_V1176F )
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccggaagggcguguucgugagcaacggcaccuacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcuucgugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27176 - RNA, 3816 nt, Artificial Sequence
  SARS-CoV-2/Wuhan/WIV05/2019__EPI_ISL_402128 spike protein CDS gc (1-1273)(K986P_V987P_H66D_G142V_Y144del_Y145del_D215G_V483A_D614G _H655Y_G669S_Q949R_N1187D)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguucgacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugguggugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgccgagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccagcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcgcgacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27177 - RNA, 3819 nt, Artificial Sequence
  SARS-CoV-2/Wuhan/WIV05/2019__EPI_ISL_402128 spike protein CDS gc (1-1273)(K986P_V987P_Y144del_L452R_T478K_P681R)
auguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27178 - RNA, 3816 nt, Artificial Sequence
  SARS-CoV-2/Wuhan/WIV05/2019__EPI_ISL_402128 spike protein CDS gc (1-1273)(K986P_V987P_T19R_Y144del_Y145del_L452R_T478K_D614G_P681R )
auguucguguuccuggugcugcugccccuggugagcagccagugcgugaaccugcgcacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcgugcacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaagccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacgccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccuga

SEQ ID NO: 27179 - RNA, 3813 nt, Artificial Sequence
  SARS-CoV-2/Wuhan/WIV05/2019__EPI_ISL_402128 spike protein CDS gc (1-1273)(K986P_V987P_H69del_V70del_Y144del_E484K_N501Y_A570D_D614 G_P681H_T716I_S982A_D1118H)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27180 - RNA, 3813 nt, Artificial Sequence
  SARS-CoV-2/Wuhan/WIV05/2019__EPI_ISL_402128 spike protein CDS gc (1-1273)(K986P_V987P_L18F_D80A_D215G_L242del_A243del_L244del_K417 N_E484K_N501Y_D614G_A701V)
auguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccauuugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27181 - RNA, 3813 nt, Artificial Sequence
  SARS-CoV-2/Wuhan/WIV05/2019__EPI_ISL_402128 spike protein CDS gc (1-1273)(K986P_V987P_Q52R_A67V_H69del_V70del_Y144del_E484K_D614G_ Q677H_F888L)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccgggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcucuggagccucugguggaccugcccaucggcaucaacaucacccgguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaggugaagcaaaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagccggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27182 - RNA, 3813 nt, Artificial Sequence
  SARS-CoV-2/Wuhan/WIV05/2019__EPI_ISL_402128 spike protein CDS gc (1-1273)(K986P_V987P_A67V_H69del_V70del_Y144del_E484K_D614G_Q677H _F888L)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgugaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgccaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcucuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccacaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggacccugggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccucaugagcuuuccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27183 - RNA, 3822 nt, Artificial Sequence
  SARS-CoV-2/Wuhan/WIV05/2019__EPI_ISL_402128 spike protein CDS gc (1-1273)(K986P_V987P_L18F_T20N_P26S_D138Y_R190S_K417T_E484K_N501Y _D614G_H655Y_T1027I_V1176F)
auguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27184 - RNA, 3822 nt, Artificial Sequence
  SARS-CoV-2/Wuhan/WIV05/2019__EPI_ISL_402128 spike protein CDS gc (1-1273)(K986P_V987P_E484K_D614G_V1176F)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27185 - RNA, 3822 nt, Artificial Sequence
  SARS-CoV-2/Wuhan/WIV05/2019__EPI_ISL_402128 spike protein CDS gc (1-1273)(K986P_V987P_L452R_D614G_P681R)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27186 - RNA, 3822 nt, Artificial Sequence
  SARS-CoV-2/Wuhan/WIV05/2019__EPI_ISL_402128 spike protein CDS gc (1-1273)(K986P_V987P_E154K_L452R_E484Q_D614G_P681R_Q1071H)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggaugaaguccgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacggugugcagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaagacaagaacacccaggagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccacgagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27187 - RNA, 3816 nt, Artificial Sequence
  SARS-CoV-2/Wuhan/WIV05/2019__EPI_ISL_402128 spike protein CDS gc (1-1273)(K986P_V987P_T19R_F157del_R158del_L452R_T478K_D614G_P681R _D950N)
auguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcguguacuaccacaagaacaacaagagcuggauggagagcgaggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuucaacugcuacuuuccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcuagggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucagcucagugcugaacgacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuuuccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27188 - RNA, 3801 nt, Artificial Sequence
  SARS-CoV-2/Wuhan/WIV05/2019__EPI_ISL_402128 spike protein CDS gc (1-1273)(K986P_V987P_G75V_T76I_R246del_S247del_Y248del_L249del_T2 50del_P251del_G252del_L452Q_F490S_D614G_T859N)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacgugaucaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgucuacuaccacaagaacaacaagagcuggauggagagcgaguuccggguguacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggcuucagcgcccuggagccucugguggaccugcccaucggaaucaacaucaccagguuccagacccugcuggcccugcacgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcauugugcgguuccccaacaucaccaaccugugucccuucggcgagguguucaacgccacucgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccaguaccggcuguuccguaagagcaaccugaagcccuucgagcgggacaucagcaccgagaucuaccaggccggcagcaccccaugcaacggcguggagggcuuuaacugcuacagcccccugcagagcuacgguuuccagcccaccaacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgucagcgugaucaccccaggcaccaacaccagcaaccagguggccgugcuguaccagggcgugaacugcacagaggugcccguggccauccacgccgaccagcugacccccaccuggcggguguacagcaccggcagcaacguguuccagacccgggccggaugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaacuuacugcugcaguacggcagcuucugcacccagcugaaccgggcccugaccggcaucgccguggagcaagacaagaacacccaggagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacggccugaacgugcugccuccccugcugacugacgagaugaucgcccaguacaccagcgcccugcuggccgggaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuuuccccagagcgcuccccacggcgugguguuccugcacgucaccuacgugcccgcccaggagaagaacuucaccaccgcccccgccaucugccacgacggcaaggcccacuucccccgggagggcguguucgugagcaacggcacacacugguucgugacccagcggaacuucuacgagccccagaucaucaccaccgacaacaccuucgugagcggaaacugcgacguggugaucggcaucgugaacaacaccguguacgacccucugcagcccgagcucgacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27189 - RNA, 3816 nt, Artificial Sequence
  SARS-CoV-2/Wuhan/WIV05/2019__EPI_ISL_402128 spike protein CDS gc (1-1273)(K986P_V987P_H69del_V70del_N439K_D614G)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27190 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_E484K_D614G_A701V)
auguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguagcacccccugcaacggcgugaagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaucugaucugcgcucagaaguucaacggccugaccgugcugcccccucugcugaccgacgagaugaucgcccaguacaccagcgcccugcuggccggcaccaucaccagcggcuggaccuucggcgccggcgccgcacuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucaccuacgugcccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27191 - RNA, 3822 nt, Artificial Sequence
  SARS-CoV-2/Wuhan/WIV05/2019__EPI_ISL_402128 spike protein CDS gc (1-1273)(K986P_V987P_L5F_T95I_D253G_S477N_D614G_Q957R)
auguucguguucuucgugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuuuggcaccacccuggacagcaagacccagagccugcugaucgugaacaacgccacaaacguggugaucaaggugugcgaguuccaguucugcaacgaccccuuccugggcguguacuaccacaagaacaacaagagcuggauggagagcgaguuccgggucuacagcagcgcuaacaauugcaccuucgaguacgugagccagcccuuccugauggaccuggagggcaagcagggcaacuucaagaaccuccgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcggcagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcauugugcgguuccccaacaucacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccgguaacacccccugcaacggcguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggacaucgccgauaccaccgacgcagugcgggacccccagacccuggagauccuggacaucaccccaugcagcuucggcggcgugagcgucaucacccccggaaccaacacaagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcucgggaucugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcuagggcccugaacacccuggugaagcagcugagcagcaauuuuggcgccaucagcagcgugcugaacgacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27192 - RNA, 3822 nt, Artificial Sequence
  SARS-CoV-2/Wuhan/WIV05/2019__EPI_ISL_402128 spike protein CDS gc (1-1273)(K986P_V987P_F157L_V367F_Q613H_P681R)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgagcugcgggucuacagcagcgcuaacaauugcaccuucgaguacgugagccagcccuuccucauggaccuggagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcuuccuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccacgacgugaacugcaccgaggugcccguggccauccacgccgaccagcugacccccaccuggcggguguacagcaccggaagcaacguguuccagacccgggccggcugcuuaaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugccuccccugcugaccgacgagaugaucgcccaguacaccagcgcccuucuggccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccucaugagcuucccccagagcgcuccccacggcgugguguuccugcacgugacauacgugcccgcccaggagaagaacuucaccaccgcccccgccauuugccacgacggcaaggcccacuucccccgggagggcgucuucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27193 - RNA, 3822 nt, Artificial Sequence
  SARS-CoV-2/Wuhan/WIV05/2019__EPI_ISL_402128 spike protein CDS gc (1-1273)(K986P_V987P_S254F_D614G_P681R_G769V)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacuucagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagccggcggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccgugaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgccgcucgggaccugaucugcgcccagaaguucaacgggcugaccgugcugccuccccugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcagcgugcugaaugacauccugucacggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27194 - RNA, 3804 nt, Artificial Sequence
  SARS-CoV-2/Wuhan/WIV05/2019__EPI_ISL_402128 spike protein CDS gc (1-1273)(K986P_V987P_P26S_H69del_V70del_V126A_Y144del_L242del_A24 3del_L244del_H245Y_S477N_E484K_D614G_P681H_T1027I_D1118H)
auguucguguuccuggugcugcugccccuggugagcagccagugcgugaaccugaccacccggacccagcugcccagcgccuacaccaacagcuucacccggggcguguacuacccugacaagguguuccggagcagcgugcugcacagcacccaggaccuguuccugcccuucuucagcaacgugaccugguuccacgccaucagcggcaccaacggcaccaagcgguucgacaaccccgugcugccauucaacgacggcguguacuucgccagcaccgagaagucaaacaucauccggggcuggaucuucggcaccacccuggacagcaagacacagagccugcugaucgugaacaacgccaccaacgcugugaucaaggugugcgaguuucaguucugcaacgaccccuuccugggcguguaccacaagaacaacaagagcuggauggagagcgaguuccggguguacagcagcgccaacaauugcaccuucgaguacgugagccagcccuuccugauggaccucgagggcaagcagggcaacuucaagaaccugcgggaguucgucuucaagaacaucgauggcuacuucaagaucuacagcaagcacacccccaucaaccuggugcgggaccugccccagggauucagcgcccuggagccccugguggaccugccuaucggcaucaacaucaccagguuccagacccuguaccggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuucgagcgggacaucagcaccgagaucuaccaggccggcaacaccccaugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggccccaaaaagagcaccaaccuggugaagaacaagugcgugaauuucaacuucaacggccugaccggcaccggcgugcugaccgagagcaacaagaaguuccugccuuuccagcaguucggccgggauaucgccgacaccaccgacgcagugcgggacccccagacccuggagauccuggacaucacccccugcagcuucggcggcgugagcgugaucaccccaggcacaaacaccagcaaccagguggccguccuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagccugggcgccgagaacagcguggccuacagcaacaacagcaucgcgauccccaccaacuucaccaucagcgugaccaccgagauacugcccgugagcaugaccaagaccagcguggacuguaccauguacaucugcggcgacagcaccgagugcagcaacuuacugcugcaguacggcagcuucugcacccagcugaaccgggcccugaccggcaucgccguggagcaggacaagaacacccaagagguguucgcccaggugaagcagaucuacaagacuccucccaucaaggacuucggcggcuucaacuucagccagauccugcccgacccaagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuggccggcaccaucaccagcggcuggaccuucggcgccggcgcagcccugcagauccccuucgccaugcagauggccuaccgguucaacggcaucggcgugacccagaacgugcuuuacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaccuggcagccauuaagaugagcgagugcgugcugggccagagcaagcggguggacuuuugcggcaagggcuaccaccugaugagcuucccccagagcgcuccccacggcgugguguuccugcacgugaccuacgugcccgcccaggagaagaacuucacaaccgcccccgccaucugccacgacggcaaggcccacuucccccgggagggaguguucgucagcaacggcacccacugguucgugacccagcggaacuucuacgagccccagaucaucaccacccacaacaccuucgugagcggcaacugcgacguggugaucggcaucgugaacaacaccguguacgacccccugcagccugagcucgacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccuaa

SEQ ID NO: 27195 - RNA, 3825 nt, Artificial Sequence
  SARS-CoV-2/Wuhan/WIV05/2019__EPI_ISL_402128 spike protein CDS gc (1-1273)(K986P_V987P_T95I_Y144T_Y145S_ins145N_R346K_E484K_N501Y_D 614G_P681H_D950N)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaucgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugaccagcaaccacaagaacaacaagagcuggauggagagcgaguuccgggucuacagcagcgcuaauaacugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcauugugcgguuccccaacaucaccaaccugugucccuucggcgagguguucaacgccaccaaguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcuccaacguguuccagacccgggccggcugccugaucggcgccgagcacgugaacaacagcuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcagaacguggugaaccagaacgcucaggcccugaacacccuggugaagcagcugagcagcaauuucggcgccaucucaagcgugcugaacgacauccugagccggcuggacccacccgaggccgaggugcagaucgacaggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27196 - RNA, 3831 nt, Artificial Sequence
  SARS-CoV-2/Wuhan/WIV05/2019__EPI_ISL_402128 spike protein CDS gc (1-1273)(K986P_V987P_ins214TDR_Q414K_N450K_D614G_T716I)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcggaccgacagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagacuagcaacuuccgggugcagcccaccgagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggcaagaccggcaagaucgccgacuacaacuacaagcugcccgacgacuucaccggcugcgugaucgccuggaacagcaacaaccuggacagcaaggugggcggcaacuacaaguaccuguaccggcuguuccguaagagcaaccugaagccauucgagcgggauaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggacaucgccgacaccaccgacgcagugcgggacccccagacccuggagauccuggacaucaccccaugcagcuucggcggcgugagcgucaucacacccggcaccaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaucaacuucaccauaagcgugaccaccgagauccugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaggagguguucgcccaagugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggggacaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagccggcuggaucccccagaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27197 - RNA, 3822 nt, Artificial Sequence
  SARS-CoV-2/Wuhan/WIV05/2019__EPI_ISL_402128 spike protein CDS gc (1-1273)(K986P_V987P_T478K_D614G_P681H_T732A)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcauggccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgcugcccgggaccugaucugcgcccagaaguucaacggccugacugugcugccuccccugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugcaggacguggugaaccagaacgcccaggcccugaacacccuggugaagcagcugagcagcaacuucggcgccaucagcucagugcugaaugacauccugagcaggcuggacccacccgaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27198 - RNA, 3822 nt, Artificial Sequence
  SARS-CoV-2/Wuhan/WIV05/2019__EPI_ISL_402128 spike protein CDS gc (1-1273)(K986P_V987P_E484K_N501Y_D614G_P681H_E1092K_H1101Y_V1176F )
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccaccggcgggcccggagcguggccagccagagcaucaucgccuacaccaugagcuuaggcgccgagaacagcguggccuacagcaacaacagcaucgcgauccccaccaacuucaccaucagcgugaccaccgagauacugccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugccuccccugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacccacccgaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccggaagggaguguucgugagcaacggcaccuacugguucgugacccagcggaacuucuacgagccccagaucaucaccaccgacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcuucgugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27199 - RNA, 3816 nt, Artificial Sequence
  SARS-CoV-2/Wuhan/WIV05/2019__EPI_ISL_402128 spike protein CDS gc (1-1273)(K986P_V987P_H66D_G142V_Y144del_Y145del_D215G_V483A_D614G _H655Y_G669S_Q949R_N1187D)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguucgacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccuggugguccacaagaacaacaagagcuggauggagagcgaguuccggguguacagcagcgcuaacaauugcaccuucgaguacgugagccagcccuuccugauggaucucgagggcaagcagggcaacuucaagaaccugcgggaguucguguucaagaacaucgacggcuacuucaagaucuacagcaagcacacccccaucaaccuggugcggggccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugccgagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgcagacaccaccgacgccgugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgcugaguacgugaacaacuccuacgagugcgacauccccaucggcgccagcaucugcgccagcuaccagacccagaccaacagcccccggcgggcccggagcguggccagccagagcaucaucgccuacaccaugagcuuaggcgccgagaacagcguggcguacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggcgauaucgcugcccgggaccugaucugcgcccagaaguucaacgggcugaccgugcugcccccucugcugaccgacgagaugaucgcccaguacaccagcgcccugcuugccggcaccaucaccagcggcuggaccuucggcgcaggcgccgcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcucugggcaagcugagggacguggugaaccagaacgcccaggcccugaacacccuggugaagcagcugagcagcaacuucggcgccaucucaagcgugcugaaugacauccugagccggcuggaucccccagaggccgaggugcagaucgaccggcugaucaccggccggcugcagagccugcagaccuacgugacccagcagcugauccgggccgccgagauccgggccagcgcaaaccuggccgccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcuggacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27200 - RNA, 3819 nt, Artificial Sequence
  SARS-CoV-2/Wuhan/WIV05/2019__EPI_ISL_402128 spike protein CDS gc (1-1273)(K986P_V987P_Y144del_L452R_T478K_P681R)
auguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacacaagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggcgacaucgccgcuagggaccugaucugcgcccagaaguucaacgggcugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucacaaccgcccccgccauuugccacgacggcaaggcccacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27201 - RNA, 3816 nt, Artificial Sequence
  SARS-CoV-2/Wuhan/WIV05/2019__EPI_ISL_402128 spike protein CDS gc (1-1273)(K986P_V987P_T19R_Y144del_Y145del_L452R_T478K_D614G_P681R )
auguucguguuccuggugcugcugccccuggugagcagccagugcgugaaccugcggacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacccagagccugcugaucgugaacaacgccacaaacguggugaucaaggugugcgaguuucaguucugcaacgaccccuuccugggcgugcacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugagggaccugccccagggauucagcgcccuggagccucugguggaccugcccaucggcaucaacaucacccgguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcaagcccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcaccaacaccagcaaccagguggccgugcuguaccagggagugaacugcacagaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagccggcggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagaccccacccaucaaggacuucggcggcuucaacuucagccagauccugcccgaccccagcaagcccagcaagaggagcuucaucgaggaccugcuguucaacaaggugacccuggccgacgccggcuucaucaagcaguacggcgacugccugggggauaucgccgcucgggaccugaucugcgcccagaaguucaacggccugacugugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagccggcuggacccacccgaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugaccuacguccccgcccaggagaagaacuucaccacagcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccuaa

SEQ ID NO: 27202 - RNA, 3813 nt, Artificial Sequence
  SARS-CoV-2/Wuhan/WIV05/2019__EPI_ISL_402128 spike protein CDS gc mod (1-1273)(K986P_V987P_H69del_V70del_Y144del_E484K_N501Y_A570D_D614 G_P681H_T716I_S982A_D1118H)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27203 - RNA, 3813 nt, Artificial Sequence
  SARS-CoV-2/Wuhan/WIV05/2019__EPI_ISL_402128 spike protein CDS gc mod (1-1273)(K986P_V987P_L18F_D80A_D215G_L242del_A243del_L244del_K417 N_E484K_N501Y_D614G_A701V)
auguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27204 - RNA, 3813 nt, Artificial Sequence
  SARS-CoV-2/Wuhan/WIV05/2019__EPI_ISL_402128 spike protein CDS gc mod (1-1273)(K986P_V987P_Q52R_A67V_H69del_V70del_Y144del_E484K_D614G_ Q677H_F888L)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccgcgaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27205 - RNA, 3813 nt, Artificial Sequence
  SARS-CoV-2/Wuhan/WIV05/2019__EPI_ISL_402128 spike protein CDS gc mod (1-1273)(K986P_V987P_A67V_H69del_V70del_Y144del_E484K_D614G_Q677H _F888L)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgugaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacacacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacacugggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27206 - RNA, 3822 nt, Artificial Sequence
  SARS-CoV-2/Wuhan/WIV05/2019__EPI_ISL_402128 spike protein CDS gc mod (1-1273)(K986P_V987P_L18F_T20N_P26S_D138Y_R190S_K417T_E484K_N501Y _D614G_H655Y_T1027I_V1176F)
auguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27207 - RNA, 3822 nt, Artificial Sequence
  SARS-CoV-2/Wuhan/WIV05/2019__EPI_ISL_402128 spike protein CDS gc mod (1-1273)(K986P_V987P_E484K_D614G_V1176F)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcuucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27208 - RNA, 3822 nt, Artificial Sequence
  SARS-CoV-2/Wuhan/WIV05/2019__EPI_ISL_402128 spike protein CDS gc mod (1-1273)(K986P_V987P_L452R_D614G_P681R)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 27209 - RNA, 3822 nt, Artificial Sequence
  SARS-CoV-2/Wuhan/WIV05/2019__EPI_ISL_402128 spike protein CDS gc mod (1-1273)(K986P_V987P_E154K_L452R_E484Q_D614G_P681R_Q1071H)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggaugaagagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcgugcagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccgcagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucacgagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

(The sequence listing continues in the following parts.)

9. The composition of claim 1, wherein the mRNA comprises a nucleotide analog substitution.

10. The composition of claim 9, wherein the mRNA comprises a pseudouridine or 1-methylpseudouridine substitution at a uridine position.

11. The composition of claim 10, wherein the mRNA comprises a 1-methylpseudouridine substitution at a uridine position.

12. The composition of claim 1, wherein the mRNA has an RNA integrity of at least about 50%.

13. The composition of claim 1, wherein the mRNA is a purified mRNA that has been purified by reversed-phase high pressure liquid chromatography and/or tangential flow filtration.

14. The composition of claim 13, wherein the mRNA is a purified mRNA that has been purified by reversed-phase high pressure liquid chromatography and/or tangential flow filtration and comprises about 5%, 10%, or 20% less double stranded RNA side products as compared to an RNA that has not been purified with reversed-phase high pressure liquid chromatography and/or tangential flow filtration.

15. The composition of claim 1, wherein the LNP comprises a cationic lipid according to formula III:

(III)

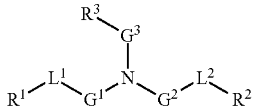

or a pharmaceutically acceptable salt, tautomer, prodrug or stereoisomer thereof, wherein:

$L_1$ or $L^2$ is each independently —O(C═O)—, —(C═O)O—, —C(═O)—, —O—, —S(O)$_x$—, —S—S—, —C(═O)S—, —SC(═O)—, NR$^a$C(═O)—, —C(═O)NRa—, —NR$^a$C(═O)NR$^a$—, —OC(═O)NR$^a$— or —NR$^a$C(═O)O—;

$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, or $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, $OR^5$, CN, —C(═O)OR$^4$, —OC(═O)R$^4$ or —NR$^5$C(═O)R$^4$;

$R^4$ is $C_1$-$C_{12}$ alkyl; and $R^5$ is H or $C_1$-$C_6$ alkyl.

16. The composition of claim 15, wherein $L^1$ or $L^2$ is —O(C═O)— or —(C=O)O—.

17. The composition of claim 15, wherein the LNP further comprises:

(i) at least one neutral lipid comprising 1,2-distearoyl-sn-glycero-3-phosphocholine (DSPC); and (ii) at least one sterol comprising cholesterol.

18. The composition of claim 15, wherein the mRNA comprises a sequence at least 90% identical to SEQ ID NO: 163.

19. The composition of claim 1, further comprising a lyoprotectant.

20. The composition of claim 18, wherein the lyoprotectant comprises sucrose.

21. The composition of claim 1, wherein the composition comprises less than about 20% free mRNA.

22. The composition of claim 1, wherein the LNP have a mean diameter of from about 60 nm to 200 nm.

23. The composition of claim 1, wherein the composition has a cationic lipid to RNA molar ratio (N/P ratio) of from about 2 to about 12.

24. A kit comprising the composition of claim 1 and optionally comprising a liquid vehicle for solubilising, and, optionally, technical instructions providing information on administration and dosage for use.

* * * * *